United States Patent
Hunt et al.

(10) Patent No.: US 12,521,451 B2
(45) Date of Patent: Jan. 13, 2026

(54) CRISPR AND AAV STRATEGIES FOR X-LINKED JUVENILE RETINOSCHISIS THERAPY

(71) Applicant: Regeneron Pharmaceuticals, Inc., Tarrytown, NY (US)

(72) Inventors: Charleen Hunt, Montvale, NJ (US); Yang Liu, Valhalla, NY (US); Guochun Gong, Pleasantville, NY (US); Carmelo Romano, Tarrytown, NY (US); Brian Zambrowicz, Sleepy Hollow, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 925 days.

(21) Appl. No.: 17/774,284

(22) PCT Filed: Nov. 7, 2020

(86) PCT No.: PCT/US2020/059568
§ 371 (c)(1),
(2) Date: May 4, 2022

(87) PCT Pub. No.: WO2021/092513
PCT Pub. Date: May 14, 2021

(65) Prior Publication Data
US 2023/0001019 A1    Jan. 5, 2023

Related U.S. Application Data

(60) Provisional application No. 62/932,608, filed on Nov. 8, 2019.

(51) Int. Cl.
| | |
|---|---|
| A61K 48/00 | (2006.01) |
| A61P 27/02 | (2006.01) |
| C07K 14/705 | (2006.01) |
| C12N 9/22 | (2006.01) |
| C12N 15/11 | (2006.01) |
| C12N 15/86 | (2006.01) |
| C12N 15/90 | (2006.01) |

(52) U.S. Cl.
CPC .......... *A61K 48/0058* (2013.01); *A61P 27/02* (2018.01); *C07K 14/7056* (2013.01); *C12N 9/22* (2013.01); *C12N 15/11* (2013.01); *C12N 15/86* (2013.01); *C12N 15/907* (2013.01); *C12N 2310/20* (2017.05); *C12N 2750/14143* (2013.01)

(58) Field of Classification Search
None
See application file for complete search history.

(56) References Cited

U.S. PATENT DOCUMENTS

| | | | |
|---|---|---|---|
| 7,465,583 | B2 | 12/2008 | Samulski et al. |
| 8,865,406 | B2 | 10/2014 | Zhang et al. |
| 9,873,893 | B2 | 1/2018 | Sieving et al. |
| 10,350,306 | B2 | 7/2019 | Sieving et al. |
| 10,577,630 | B2 | 3/2020 | Zhang et al. |
| 10,612,041 | B2 | 4/2020 | Barzel et al. |
| 10,767,175 | B2 | 9/2020 | Dellinger et al. |
| 2003/0108524 | A1 | 6/2003 | Diagana et al. |
| 2014/0155468 | A1 | 6/2014 | Gregory et al. |
| 2014/0294771 | A1 | 10/2014 | Schaffer et al. |
| 2015/0240263 | A1 | 8/2015 | Holmes et al. |
| 2016/0002666 | A1 | 1/2016 | Sieving et al. |
| 2016/0153006 | A1 | 6/2016 | Zhang et al. |
| 2016/0289675 | A1 | 10/2016 | Ryan et al. |
| 2016/0298099 | A1 | 10/2016 | Kormann et al. |
| 2016/0298134 | A1 | 10/2016 | Chen et al. |
| 2016/0340661 | A1 | 11/2016 | Cong et al. |
| 2017/0198302 | A1 | 7/2017 | Feng et al. |
| 2017/0355999 | A1 | 12/2017 | Rabar |
| 2018/0064827 | A1 | 3/2018 | Conway et al. |
| 2018/0119140 | A1 | 5/2018 | Porteus et al. |
| 2018/0179553 | A1 | 6/2018 | Watson et al. |
| 2018/0185516 | A1 | 7/2018 | Ansell et al. |
| 2018/0214577 | A1 | 8/2018 | Sieving et al. |
| 2018/0251791 | A1 | 9/2018 | Doudna et al. |
| 2019/0002869 | A1 | 1/2019 | Yin et al. |
| 2019/0010490 | A1 | 1/2019 | Cowan et al. |
| 2019/0038724 | A1 | 2/2019 | Buchlis et al. |
| 2019/0076551 | A1 | 3/2019 | Bogorad et al. |
| 2019/0112353 | A1 | 4/2019 | Zhang et al. |

(Continued)

FOREIGN PATENT DOCUMENTS

| | | |
|---|---|---|
| EP | 1308517 A1 | 5/2003 |
| EP | 3138910 B1 | 9/2017 |

(Continued)

OTHER PUBLICATIONS

Huang et al., "Morphological and Molecular Defects in Human Three-Dimensional Retinal Organoid Model of X-Linked Juvenile Retinoschisis" 13 Stem Cell Reports 906-923 (Year: 2019).*
Shengru et al., "A Patient-Specific Point Mutation Mouse Model of X-Linked Retinoschisis by CRISPR/Cas9 System" 60 Investigative Ophthalmology & Visual Science 4211 (Year: 2019).*
Bush et al., "Convergence of Human Genetics and Animal Studies: Gene Therapy for X-Linked Retinoschisis," Cold Spring Harb. Perspect. Med., 5(8):a017368, (Jun. 22, 2015).
Chan et al., "Learning to predict expression efficacy of vectors in recombinant protein production," BMC Bioinformatics, 11 Suppl 1:S21, (Jan. 18, 2010).
Chugunova et al., "Methods of Genome Engineering: a New Era of Molecular Biology," Biochemistry (Mosc.), 81(7):662-677, (Jul. 2016).

(Continued)

*Primary Examiner* — Nancy J Leith
(74) *Attorney, Agent, or Firm* — Alston & Bird LLP

(57) ABSTRACT

Nucleic acid constructs and compositions that allow insertion and/or expression of a retinoschisin coding sequence are provided. Nuclease agents targeting RS1 loci are provided. Compositions and methods of using such constructs for integration into a target genomic locus and/or expression in a cell are also provided. Methods of treating X-linked juvenile retinoschisis using the nucleic acid constructs and compositions are also provided.

19 Claims, 15 Drawing Sheets
Specification includes a Sequence Listing.

(56) References Cited

U.S. PATENT DOCUMENTS

| | | |
|---|---|---|
| 2019/0136231 A1 | 5/2019 | Morrissey et al. |
| 2019/0153440 A1 | 5/2019 | Kantardzhieva et al. |
| 2019/0185844 A1 | 6/2019 | Gagnon et al. |
| 2019/0211362 A1 | 7/2019 | Lundberg et al. |
| 2019/0225991 A1 | 7/2019 | Izpisua Belmonte et al. |
| 2019/0247517 A1 | 8/2019 | Brooks |
| 2019/0316121 A1 | 10/2019 | Smith et al. |
| 2019/0352671 A1 | 11/2019 | Holmes et al. |
| 2019/0365924 A1 | 12/2019 | Conway et al. |
| 2019/0376051 A1 | 12/2019 | Kormann et al. |
| 2019/0382798 A1 | 12/2019 | Cowan et al. |
| 2019/0390195 A1 | 12/2019 | Tondera et al. |
| 2020/0040362 A1 | 2/2020 | Carlo et al. |
| 2020/0080082 A1 | 3/2020 | Lundberg et al. |
| 2020/0115700 A1 | 4/2020 | Baltes |
| 2020/0172564 A1 | 6/2020 | Dombrowski |
| 2020/0190504 A1 | 6/2020 | Baltes |
| 2020/0208146 A1 | 7/2020 | Clark et al. |
| 2020/0231974 A1 | 7/2020 | Jarvis et al. |
| 2020/0268906 A1 | 8/2020 | Finn et al. |
| 2020/0270617 A1 | 8/2020 | Finn et al. |
| 2020/0270618 A1 | 8/2020 | Finn et al. |
| 2020/0289628 A1 | 9/2020 | Finn et al. |
| 2020/0340015 A1 | 10/2020 | Dahlman et al. |
| 2020/0384125 A1 | 12/2020 | Brooks |
| 2021/0079427 A1 | 3/2021 | Chen et al. |
| 2021/0130850 A1 | 5/2021 | Joung et al. |
| 2021/0171985 A1 | 6/2021 | Carlo et al. |
| 2021/0180053 A1 | 6/2021 | Beverly et al. |
| 2021/0198696 A1 | 7/2021 | Kong et al. |
| 2021/0316014 A1 | 10/2021 | Finn et al. |
| 2021/0332347 A1 | 10/2021 | Baltes |
| 2021/0348159 A1 | 11/2021 | Brooks et al. |
| 2022/0354967 A1 | 11/2022 | Finn et al. |
| 2022/0387560 A1 | 12/2022 | Buchlis et al. |
| 2022/0402862 A1 | 12/2022 | Scully et al. |

FOREIGN PATENT DOCUMENTS

| | | | |
|---|---|---|---|
| EP | 3196301 B1 | 10/2018 | |
| EP | 3138911 B1 | 12/2018 | |
| EP | 3470089 A1 | 4/2019 | |
| EP | 3011032 B2 | 10/2019 | |
| EP | 3089725 B1 | 10/2019 | |
| EP | 3620524 A1 | 3/2020 | |
| EP | 3640335 A2 | 4/2020 | |
| EP | 3653229 A1 | 5/2020 | |
| EP | 2839013 B1 | 8/2020 | |
| EP | 3011031 B1 | 9/2020 | |
| JP | 2016-510221 A | 4/2016 | |
| WO | WO 2011/011767 A1 | 1/2011 | |
| WO | WO 2011/100058 A1 | 8/2011 | |
| WO | WO 2012/145601 A2 | 10/2012 | |
| WO | WO 2014/186585 A2 | 11/2014 | |
| WO | WO 2015/089077 A2 | 6/2015 | |
| WO | WO 2015/127439 A1 | 8/2015 | |
| WO | WO 2016/176690 A2 | 11/2016 | |
| WO | WO 2017/077386 A1 | 5/2017 | |
| WO | WO 2017/091512 A1 | 6/2017 | |
| WO | WO 2017/093804 A2 | 6/2017 | |
| WO | WO 2017/109757 A1 | 6/2017 | |
| WO | WO 2017/134529 A1 | 8/2017 | |
| WO | WO 2017/141109 A1 | 8/2017 | |
| WO | WO 2017/158422 A1 | 9/2017 | |
| WO | WO 2017/173054 A1 | 10/2017 | |
| WO | WO 2018/007871 A1 | 1/2018 | |
| WO | WO 2018/013720 A1 | 1/2018 | |
| WO | WO 2018/013932 A1 | 1/2018 | |
| WO | WO 2018/107026 A1 | 6/2018 | |
| WO | WO 2018/107028 A1 | 6/2018 | |
| WO | WO 2018/126087 A1 | 7/2018 | |
| WO | WO 2018/220211 A1 | 12/2018 | |
| WO | WO 2018/232382 A1 | 12/2018 | |
| WO | WO 2019/010384 A1 | 1/2019 | |
| WO | WO 2019/036513 A1 | 2/2019 | |
| WO | WO 2019/067910 A1 | 4/2019 | |
| WO | WO 2019/067992 A1 | 4/2019 | |
| WO | WO 2019/079527 A1 | 4/2019 | |
| WO | WO 2020/072605 A1 | 4/2019 | |
| WO | WO 2019/113310 A1 | 6/2019 | |
| WO | WO 2019/118875 A1 | 6/2019 | |
| WO | WO 2019/122302 A1 | 6/2019 | |
| WO | WO 2019/134561 A1 | 7/2019 | |
| WO | WO 2019/140330 A1 | 7/2019 | |
| WO | WO 2019/161310 A1 | 8/2019 | |
| WO | WO 2019/183630 A2 | 9/2019 | |
| WO | WO 2019/212973 A1 | 11/2019 | |
| WO | WO 2019/237069 A1 | 12/2019 | |
| WO | WO 2019/239361 A1 | 12/2019 | |
| WO | WO 2019/246203 A1 | 12/2019 | |
| WO | WO 2020/006126 A1 | 1/2020 | |
| WO | WO 2020/006131 A2 | 1/2020 | |
| WO | WO 2020/006132 A1 | 1/2020 | |
| WO | WO 2020/014577 A1 | 1/2020 | |
| WO | WO 2020/032986 A1 | 2/2020 | |
| WO | WO 2020/046861 A1 | 3/2020 | |
| WO | WO 2020/047531 A1 | 3/2020 | |
| WO | WO 2020/055941 A1 | 3/2020 | |
| WO | WO 2020/079033 A1 | 4/2020 | |
| WO | WO 2020/081843 A1 | 4/2020 | |
| WO | WO 2020/081869 A1 | 4/2020 | |
| WO | WO 2020/082041 A1 | 4/2020 | |
| WO | WO 2020/082042 A2 | 4/2020 | |
| WO | WO 2020/082046 A2 | 4/2020 | |
| WO | WO 2020/082047 A1 | 4/2020 | |
| WO | WO 2020/112908 A2 | 6/2020 | |
| WO | WO 2020/118041 A1 | 6/2020 | |
| WO | WO 2020/168362 A1 | 8/2020 | |
| WO | WO 2020/210552 A1 | 10/2020 | |
| WO | WO 2021/092513 A1 | 5/2021 | |
| WO | WO 2021/202421 A1 | 10/2021 | |
| WO | WO 2021/224416 A1 | 11/2021 | |

OTHER PUBLICATIONS

Griesenbach et al., "Cystic Fibrosis Gene Therapy in the UK and Elsewhere," Hum. Gene Ther., 26(5):266-275, (May 2015).

Keskin et al., "A new, structurally nonredundant, diverse data set of protein-protein interfaces and its implications," Protein Sci., 13(4):1043-1055, (Apr. 2004).

Pakula and Sauer, "Genetic analysis of protein stability and function," Annu. Rev. Genet. 23:289-310, (1989).

Ali, et al., "Gene therapy for inherited retinal degeneration," Br. J. Ophthalmol., 81(9):795-801, (1997).

Anguela, et al., "In Vivo Genome Editing of Liver Albumin for Therapeutic Gene Expression: Rescue of Hemophilic Mice Via Integration of Factor 9," Blood, 120(21):751, (2012).

Barzel, et al., "Promoterless gene targeting without nucleases ameliorates haemophilia B in mice," Nature Letter, 517(7534):360-364, (2014).

Barzel, et al., "Promoterless gene targeting without nucleases ameliorates haemophilia B in mice," Nature, 517(7534):360-364, (2015).

Bellingrath et al., "Gene therapy as a treatment concept for inherited retinal diseases," Ophthalmologe, 112(9):720-727, (2015).

Bush, et al., "Cog-Wheel Octameric Structure of RS1, the Discoidin Domain Containing Retinal Protein Associated with X-Linked Retinoschisis," PLoS One, 11(1):e0147653, (2016).

Bush, et al., "Preclinical Dose-Escalation Study of Intravitreal AAV-RS1 Gene Therapy in a Mouse Model of X-linked Retinoschisis: Dose-Dependent Expression and Improved Retinal Structure and Function," Hum. Gene Ther., 27(5):376-389, (2016).

Cheong, et al., "Editing of mouse and human immunoglobulin genes by CRISPR-Cas9 system," Nat. Commun., 7:10934, doi: 10.1038/ncomms10934, (2016).

Cruz et al., "Gene therapy on inherited retinal dystrophies: an update," (2018) [Retrieved from the Internet Feb. 10, 2021: <URL: https://addi.ehu.es/bitstream/handle/10810/30847/TFG_Crespo_Cruz_Rev.pdf?sequence=4&isAllowed=y>].

Cukras et al., "Retinal AAV8-RS1 Gene Therapy for X-Linked Retinoschisis: Initial Findings from a Phase I/IIa Trial by Intravitreal Delivery," Mol. Ther. 26(9):2282-2294, (2018).

(56) References Cited

OTHER PUBLICATIONS

Dalkara, et al., "In Vivo-Directed Evolution of a New Adeno-Associated Virus for Therapeutic Outer Retinal Gene Delivery from the Vitreous," Sci. Transl. Med., 5(189):189ra76, (2013).
Deng, et al., "Bidirectional promoter trapping T-DNA for insertional mutagenesis in Verticillium dahliae," Can. J. Microbiol., 60(7):445-454, (2014).
Dinculescu et al., "Adeno-associated virus-vectored gene therapy for retinal disease," Hum. Gene Ther. 16(6):649-663, (2005).
Dreyer, et al., "Improved antiviral efficacy using TALEN-mediated homology directed recombination to introduce artificial primary miRNAs into DNA of Hepatitis B virus," Biochem. Biophy. Res. Commun., 478(4):1563-1568, (2016).
Feng, Bo, "High-efficiency CRISPR-based technology for hemophilia B gene therapy," A-Biotech (Hong Kong) Co. Ltd. (2018).
Grayson, et al., "Retinoschisin, the X-linked retinoschisis protein, is a secreted photoreceptor protein, and is expressed and released by Weri-Rb1 cells," Hum. Mol. Genet., 9(12):1873-1879, (2000).
Greiner, et al., "CRISPR-Mediated Editing of the B Cell Receptor in Primary Human B Cells," iScience, 12:369-378, (2019).
Haapaniemi et al., "CRISPR-Cas9 genome editing induces a p53-mediated DNA damage response," Nat. Med. doi: 10.1038/s41591-018-0049-z, (Jun. 11, 2018, epub ahead of print).
Hajj, et al., "Tools for translation: non-viral materials for therapeutic mRNA delivery," Nature Reviews Materials, vol. 2, Article No. 17056, doi: 10.1038/natrevmats.2017.56, (2017).
He, et al., "Knock-in of large reporter genes in human cells via CRISPR/Cas9-induced homology-dependent and independent DNA repair," Nucleic Acids Res., 44(9):e85, (2016).
Ihry et al., "p53 inhibits CRISPR-Cas9 engineering in human pluripotent stem cells," Nat. Med. doi: 10.1038/s41591-018-0050-6 (Jun. 11, 2018, epub ahead of print).
Jayaraman et al., "Maximizing the Potency of siRNA Lipid Nanoparticles for Hepatic Gene Silencing In Vivo," Angew. Chem. Int. Ed., 51:8529-8533, (2012).
Kolb, et al., "Genomic targeting of a bicistronic DNA fragment by Cre-mediated site-specific recombination," Gene, 203(2):209-216, (1997).
Komor et al., "CRISPR-Based Technologies for the Manipulation of Eukaryotic Genomes," Cell, 168(1-2):20-36, (2017).
Kosicki et al., "Repair of double-strand breaks induced by CRISPR-Cas9 leads to large deletions and complex rearrangements," Nat. Biotechnol., 36(8): 765-771, (Jul. 16, 2018).
Kulkarni et al., "Lipid Nanoparticles Enabling Gene Therapies: From Concepts to Clinical Utility," Nucleic Acids Ther., 28(3):146-157, (2018).
Laoharawee, et al., "Dose-Dependent Prevention of Metabolic and Neurologic Disease in Murine MPS II by ZFN-Mediated In Vivo Genome Editing," Mol. Ther., 26(4):1127-1136, (2018).
Liu, et al., "Cas9 and AAV Vector-Based Strategies for X-linked Juvenile Retinoschisis (XLRS) Therapy," Investigative Ophthalmology & Visual Science, vol. 61, 800, (Jun. 2020).
Mcfall, et al., "Characterization of a New Continuous Cell Line Derived from a Human Retinoblastoma," Cancer Res., 37(4):1003-1010, (1977).
Mizuno et al., "Intra-embryo Gene Cassette Knockin by CRISPR/Cas9-Mediated Genome Editing with Adeno-Associated Viral Vector," iScience, 9:286-297, (2018).
Molday, et al., "X-linked juvenile retinoschisis: Clinical diagnosis, genetic analysis, and molecular mechanisms," Prog. Retin. Eye Res., 31(3):195-212, (2012).

Ohmori, et al., "CRISPR/Cas9-mediated genome editing via postnatal administration of AAV vector cures haemophilia B mice," Sci. Rep., 7(1):4159, doi:10.1038/s41598-017-04625-5, (2017).
Papapetrou, et al., "Gene Insertion Into Genomic Safe Harbors for Human Gene Therapy," Mol. Ther., 24(4):678-684, (2016).
Pellenz et al., "New Human Chromosomal Sites with "Safe Harbor" Potential for Targeted Transgene Insertion," Hum. Gene Ther., 30(7):814-828, (2019).
Porro, et al., "Promoterless gene targeting without nucleases rescues lethality of a Crigler-Najjar syndrom mouse model," EMBO Mol. Med., 9(10):1346-1355, (2017).
Ramachandran, et al., "Evaluation of Dose and Safety of AAV7m8 and AAV8BP2 in the Non-Human Primate Retina," Hum. Gene Ther., 28(2):154-167, (2017).
Ryu, et al., "Generation of T-DNA tagging lines with a bidirectional gene trap vector and the establishment of an insertion-site database," Plant Mol. Biol., 54(4):489-502, (2004).
Sengillo et al, "Correction of Monogenic and Common Retinal Disorders with Gene Therapy," Genes (Basel), 8(2):53, (2017).
Senis, et al., "TALEN/CRISPR-mediated engineering of a promoterless anti-viral RNAi hairpin into an endogenous miRNA locus," Nucleic Acids Res., 45(1):e3, doi: 10.1093/nar/gkw805, (2017).
Sharma, et al., "In vivo genome editing of the albumin locus as a platform for protein replacement therapy," Blood, 126(15):1777-1784, (2015).
Suzuki, et al., "In vivo genome editing via CRISPR/Cas9 mediated homology-independent targeted integration," Nature, 540(7631):144-149, (2016).
Tam et al., "Advances in Lipid Nanoparticles for siRNA Delivery," Pharmaceutics, 5:498-507, (2013).
Tripathi, et al., "An adenoviral vector for probing promoter activity in primary immune cells," J. Immunol. Methods, 311(1-2): 19-30, (2006).
Vijayasarathy, et al., "Molecular Mechanisms Leading to Null-Protein Product from Retinoschisin (RS1) Signal-Sequence Mutants in X-Linked Retinoschisis (XLRS) Disease," Hum. Mutat., 31(11):1251-1260, (2010).
Wechsler, et al., "ZFN-Mediated Gene Targeting at the Albumin Locus in Liver Results in Therapeutic Levels of Human Fix in Mice and Non-Human Primates," Blood, 126(23):200, Abstract only, (2015).
Wu, et al., "Defective Discoidin Domain Structure, Subunit Assembly, and Endoplasmic Reticulum Processing of Retinoschisin are Primary Mechanisms Responsible for X-linked Retinoschisis," J. Biol. Chem., 278(30):28139-28146, (2003).
Yamamoto, et al., "Making ends meet: Targeted integration of DNA fragments by genome editing," Chromosoma., 127(4):405-420, (2018).
Yang, et al., "The DNA Element Controlling Expression of the Varicella-Zoster Virus Open Reading Frame 28 and 29 Genes Consists of Two Divergent Unidirectional Promoters Which Have a Common USF Site," J. Virol., 78(20):10939-10952, (2004).
Yin, et al., "Structure-guided chemical modification of guide RNA enables potent non-viral in vivo genome editing," Nat. Biotechnol., 35(12):1179-1187, (2017).
WIPO Application No. PCT/US2020/059568, PCT International Search Report and Written Opinion of the International Searching Authority mailed Feb. 4, 2021.
Australian Application No. 2020379046, Examination Report No. 2 mailed Feb. 6, 2025.
Australian Application No. 2020379046, Notice of Acceptance mailed Feb. 26, 2025.

* cited by examiner

| AAV | | Humanized Transcript 1 | | Humanized Transcript 2 | | Mutant Mouse | | WT Mouse | | Total Reads |
|---|---|---|---|---|---|---|---|---|---|---|
| | | Read Count | Percent of Total Reads | Read Count | Percent of Total Reads | Read Count | Percent of Total Reads | Read Count | Percent of Total Reads | |
| pssAAV mhRS1-sgu | 6209 | 4843 | 66% | 1739 | 24% | 793 | 11% | | | 7375.00 |
| | 6210 | 925 | 68% | 244 | 18% | 201 | 15% | | | 1370.00 |
| | 6211 | 1583 | 87% | 0 | 0% | 245 | 13% | | | 1828.00 |
| | 6214 | 3037 | 41% | 366 | 5% | 547 | 7% | 441 | 6% | 7375.00 |
| | 6215 | 2946 | 40% | 666 | 9% | 713 | 10% | 209 | 3% | 7375.00 |
| | 6216 | 1561 | 21% | 307 | 4% | 202 | 3% | 847 | 11% | 7375.00 |
| | 6228 | 5460 | 80% | 796 | 12% | 541 | 8% | | | 6797.00 |
| | 6229 | 3037 | 70% | 860 | 20% | 430 | 10% | | | 4327.00 |
| | 6212 | 2085 | 83% | 167 | 7% | 267 | 11% | | | 2519.00 |
| pscAAV rs1_tandem | 6230 | 2762 | 81% | 266 | 8% | 370 | 11% | | | 3398.00 |
| | 6213 | 2295 | 64% | 329 | 9% | 947 | 27% | | | 3571.00 |
| | 6225 | 1987 | 27% | 0 | 0% | 135 | 2% | 349 | 5% | 7375.00 |
| | 6266 | 1416 | 19% | 125 | 2% | 397 | 5% | 337 | 5% | 7375.00 |
| | 6267 | 1145 | 16% | 64 | 1% | 433 | 6% | 1034 | 14% | 7375.00 |
| | 6227 | 3101 | 40% | | | 4608 | 60% | | | 7709.00 |
| | 6233 | 1599 | 47% | | | 1770 | 53% | | | 3369.00 |
| | 6231 | 3814 | 92% | | | 324 | 8% | | | 4138.00 |
| pssAAV hRs1_HITI | 6226 | 425 | 12% | | | 3081 | 88% | | | 3506.00 |
| | 6232 | 4429 | 65% | | | 2347 | 35% | | | 6776.00 |
| | 6224 | 463 | 6% | | | 3746 | 51% | 356 | 5% | 7375.00 |
| | 6222 | 1613 | 22% | | | 2019 | 27% | 1140 | 15% | 7375.00 |
| | 6223 | 245 | 3% | | | 211 | 3% | 0 | 0% | 7375.00 |

*FIG. 5*

| Sample_ID | Gene | Mouse ID | Virus | Sex | Block | Well | Sample_ID | Gene | %INDEL | INDEL_READS | Total reads |
|---|---|---|---|---|---|---|---|---|---|---|---|
| S37 | Rs1 | 4416227.00 | 7m8 hRS1_cDNA HITI | Male | Rs1_cDNA | B3 | S339 | Rs1 | 16.24 | 612.00 | 3768.00 |
| S38 | Rs1 | | | | Rs1_cDNA | B4 | S340 | Rs1 | 0.04 | 4.00 | 11396.00 |
| S39 | Rs1 | 4416233.00 | 7m8 hRS1_cDNA HITI | Male | Rs1_cDNA | B5 | S341 | Rs1 | 13.15 | 1575.00 | 11973.00 |
| S40 | Rs1 | | | | Rs1_cDNA | B6 | S342 | Rs1 | 0.25 | 21.00 | 8251.00 |
| S41 | Rs1 | 4416224.00 | 7m8 hRS1_cDNA HITI | Female | Rs1_cDNA | B7 | S343 | Rs1 | 10.68 | 2000.00 | 18721.00 |
| S42 | Rs1 | | | | Rs1_cDNA | B8 | S344 | Rs1 | 0.35 | 67.00 | 19102.00 |
| S43 | Rs1 | 4416231.00 | 7m8 hRS1_cDNA HITI | Male | Rs1_cDNA | F3 | S371 | Rs1 | 15.60 | 1143.00 | 7327.00 |
| S44 | Rs1 | | | | Rs1_cDNA | F4 | S372 | Rs1 | 0.03 | 3.00 | 10484.00 |
| S45 | Rs1 | 4416222.00 | 7m8 hRS1_cDNA HITI | Female | Rs1_cDNA | F5 | S373 | Rs1 | 2.28 | 750.00 | 32964.00 |
| S46 | Rs1 | | | | Rs1_cDNA | F6 | S374 | Rs1 | 0.06 | 12.00 | 21631.00 |
| S47 | Rs1 | 4416226.00 | 7m8 hRS1_cDNA HITI | Male | Rs1_cDNA | G1 | S375 | Rs1 | 44.36 | 4745.00 | 10697.00 |
| S48 | Rs1 | | | | Rs1_cDNA | G2 | S376 | Rs1 | 0.06 | 10.00 | 18139.00 |
| S49 | Rs1 | 4416232.00 | 7m8 hRS1_cDNA HITI | Male | Rs1_cDNA | G3 | S377 | Rs1 | 0.10 | 13.00 | 13314.00 |
| S50 | Rs1 | | | | Rs1_cDNA | G4 | S378 | Rs1 | 0.96 | 117.00 | 12153.00 |
| S51 | Rs1 | 4416223.00 | 7m8 hRS1_cDNA HITI | Female | Rs1_cDNA | G5 | S379 | Rs1 | 6.39 | 1218.00 | 19070.00 |
| S52 | Rs1 | | | | Rs1_cDNA | G6 | S380 | Rs1 | 0.06 | 10.00 | 17282.00 |
| S61 | Rs1 | 4416209.00 | 7m8 mhRS1-sgu | Male | Rs1_cDNA | B1 | S337 | Rs1 | 40.37 | 2558.00 | 6337.00 |
| S62 | Rs1 | | | | Rs1_cDNA | B2 | S338 | Rs1 | 0.06 | 4.00 | 7098.00 |
| S63 | Rs1 | 4416210.00 | 7m8 mhRS1-sgu | Male | Rs1_cDNA | C1 | S345 | Rs1 | 31.26 | 5276.00 | 16880.00 |
| S64 | Rs1 | | | | Rs1_cDNA | C2 | S346 | Rs1 | 0.20 | 19.00 | 9494.00 |
| S65 | Rs1 | 4416214.00 | 7m8 mhRS1-sgu | Female | Rs1_cDNA | C5 | S349 | Rs1 | 0.21 | 58.00 | 27275.00 |
| S66 | Rs1 | | | | Rs1_cDNA | C6 | S350 | Rs1 | 0.57 | 107.00 | 18717.00 |

*FIG. 6A*

| | | | | | | | | |
|---|---|---|---|---|---|---|---|---|
| S67 | Rs1 | 4416211.00 | 7m8 mhRS1-sgu | Male | Rs1_cDNA | D1 | S353 | Rs1 | 0.16 | 18.00 | 11198.00 |
| S68 | Rs1 | | | | Rs1_cDNA | D2 | S354 | Rs1 | 2.95 | 241.00 | 8171.00 |
| S69 | Rs1 | 4416215.00 | 7m8 mhRS1-sgu | Female | Rs1_cDNA | D5 | S357 | Rs1 | 1.67 | 344.00 | 20657.00 |
| S70 | Rs1 | | | | Rs1_cDNA | D6 | S358 | Rs1 | 0.71 | 131.00 | 18442.00 |
| S71 | Rs1 | 4416216.00 | 7m8 mhRS1-sgu | Female | Rs1_cDNA | E5 | S365 | Rs1 | 10.05 | 1648.00 | 16399.00 |
| S72 | Rs1 | | | | Rs1_cDNA | E6 | S366 | Rs1 | 0.27 | 52.00 | 19225.00 |
| S73 | Rs1 | 4416228.00 | 7m8 pscAAV_rs1_tandem | Male | Rs1_cDNA | C3 | S347 | Rs1 | 10.14 | 1049.00 | 10346.00 |
| S74 | Rs1 | | | | Rs1_cDNA | C4 | S348 | Rs1 | 0.11 | 15.00 | 14040.00 |
| S75 | Rs1 | 4416225.00 | 7m8 pscAAV_rs1_tandem | Female | Rs1_cDNA | C7 | S351 | Rs1 | 32.82 | 4701.00 | 14325.00 |
| S76 | Rs1 | | | | Rs1_cDNA | C8 | S352 | Rs1 | 0.05 | 8.00 | 15328.00 |
| S77 | Rs1 | 4416229.00 | 7m8 pscAAV_rs1_tandem | Male | Rs1_cDNA | D3 | S355 | Rs1 | 32.67 | 4416.00 | 13519.00 |
| S78 | Rs1 | | | | Rs1_cDNA | D4 | S356 | Rs1 | 0.09 | 15.00 | 16677.00 |
| S79 | Rs1 | 4416226.00 | 7m8 pscAAV_rs1_tandem | Female | Rs1_cDNA | D7 | S359 | Rs1 | 19.87 | 3759.00 | 18917.00 |
| S80 | Rs1 | | | | Rs1_cDNA | D8 | S360 | Rs1 | 0.13 | 25.00 | 19461.00 |
| S81 | Rs1 | 4416212.00 | 7m8 pscAAV_rs1_tandem | Male | Rs1_cDNA | E1 | S361 | Rs1 | 0.07 | 8.00 | 11742.00 |
| S82 | Rs1 | | | | Rs1_cDNA | E2 | S362 | Rs1 | 0.17 | 21.00 | 12432.00 |
| S83 | Rs1 | 4416230.00 | 7m8 pscAAV_rs1_tandem | Male | Rs1_cDNA | E3 | S363 | Rs1 | 7.06 | 986.00 | 13974.00 |
| S84 | Rs1 | | | | Rs1_cDNA | E4 | S364 | Rs1 | 1.32 | 142.00 | 10767.00 |
| S53 | Rs1 | 4416227.00 | 7m8 pscAAV_rs1_tandem | Female | Rs1_cDNA | E7 | S367 | Rs1 | 1.48 | 260.00 | 17523.00 |
| S54 | Rs1 | | | | Rs1_cDNA | E8 | S368 | Rs1 | 0.39 | 63.00 | 16357.00 |
| S55 | Rs1 | 4416213.00 | 7m8 pscAAV_rs1_tandem | Male | Rs1_cDNA | F1 | S369 | Rs1 | 19.75 | 1286.00 | 6512.00 |
| S56 | Rs1 | | | | Rs1_cDNA | F2 | S370 | Rs1 | 0.28 | 24.00 | 8481.00 |

*FIG. 6B*

CRISPR AND AAV STRATEGIES FOR X-LINKED JUVENILE RETINOSCHISIS THERAPY

CROSS-REFERENCE TO RELATED APPLICATIONS

This application is a 35 U.S.C. § 371 national stage of International Application No. PCT/US2020/059568, filed Nov. 7, 2020, which claims the benefit U.S. Application No. 62/932,608, filed Nov. 8, 2019, which are herein incorporated by reference in their entirety for all purposes.

REFERENCE TO A SEQUENCE LISTING SUBMITTED AS A TEXT FILE VIA EFS WEB

The Sequence Listing written in file 694232SEQLIST.txt is 1,280,334 bytes, was created on Nov. 6, 2020, and is hereby incorporated by reference.

BACKGROUND

The RS1 gene encodes a highly conserved extracellular protein involved in the cellular organization of the retina. It is assembled and secreted from photoreceptors and bipolar cells as a homo-oligomeric protein complex. Over 200 mutations have been detected in RS1, many leading to early onset of macular degeneration due to a non-functional protein or the absence of protein secretion. Lack of functional Rs1 expression causes schisis within the retinal layers leading to the early and progressive vision loss associated with X-linked juvenile retinoschisis (XLRS). Although there have been gene therapy clinical trials for XLRS, the trials did not meet their endpoints. New strategies are needed for treating XLRS.

SUMMARY

Nucleic acid constructs and compositions that allow insertion of a retinoschisin coding sequence into a target genomic locus such as an endogenous RS1 locus and/or expression of the retinoschisin coding sequence are provided. The nucleic acid constructs and compositions can be used in methods for integration into a target genomic locus and/or expression in a cell or in methods of treating X-linked juvenile retinoschisis.

In one aspect, provided are bidirectional nucleic acid constructs for integration into a target genomic locus. Some such nucleic acid constructs comprise: (a) a first segment comprising a first coding sequence for a first retinoschisin protein or fragment thereof; and (b) a second segment comprising a reverse complement of a second coding sequence for a second retinoschisin protein or fragment thereof. In some such constructs, the second segment is located 3' (i.e., downstream) of the first segment.

In some such constructs, the first retinoschisin protein or fragment thereof is a human retinoschisin protein or fragment thereof, the second retinoschisin protein or fragment thereof is a human retinoschisin protein or fragment thereof, or both the first retinoschisin protein or fragment thereof and the second retinoschisin protein or fragment thereof are a human retinoschisin protein or fragment thereof. In some such constructs, the first coding sequence comprises, consists essentially of, or consists of complementary DNA (cDNA), the second coding sequence comprises, consists essentially of, or consists of cDNA, or both the first coding sequence and the second coding sequence comprise, consist essentially of, or consist of cDNA. In some such constructs, the first coding sequence comprises, consists essentially of, or consists of exons 2-6 of human RS1 or degenerate variants thereof, the second coding sequence comprises, consists essentially of, or consists of exons 2-6 of human RS1 or degenerate variants thereof, or both the first coding sequence and the second coding sequence comprise, consist essentially of, or consist of exons 2-6 of human RS1 or degenerate variants thereof.

In some such constructs, the first segment comprises a fragment or portion of the first intron of human RS1 located 5' (i.e., upstream) of the first coding sequence, and/or the second segment comprises a reverse complement of a fragment or portion of the second intron of human RS1 located 3' (i.e., downstream) of the reverse complement of the second coding sequence.

In some such constructs, the first retinoschisin protein or fragment thereof is identical to the second retinoschisin protein or fragment thereof. In some such constructs, the second coding sequence adopts a different codon usage from the codon usage of the first coding sequence. In some such constructs, the second segment has at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 97%, or at least about 99% complementarity to the first segment. In some such constructs, the second segment has less than about 30%, less than about 35%, less than about 40%, less than about 45%, less than about 50%, less than about 55%, less than about 60%, less than about 65%, less than about 70%, less than about 75%, less than about 80%, less than about 85%, less than about 90%, less than about 95%, less than about 97%, or less than about 99% complementarity to the first segment. In some such constructs, the reverse complement of the second coding sequence is: (a) not substantially complementary to the first coding sequence; (b) not substantially complementary to a fragment of the first coding sequence; (c) highly complementary to the first coding sequence; (d) highly complementary to the fragment of the first coding sequence; (e) at least about 60%, at least about 70%, at least about 80%, or at least about 90% identical to the reverse complement of the first coding sequence; (f) about 50% to about 80% identical to the reverse complement of the first coding sequence; or (g) about 60% to about 100% identical to the reverse complement of the first coding sequence.

In some such constructs, the first segment is linked to the second segment by a linker. Optionally, the linker is about 5 to about 2000 nucleotides in length.

In some such constructs, the first segment comprises a first polyadenylation signal sequence located 3' of the first coding sequence, and the second segment comprises a reverse complement of a second polyadenylation signal sequence located 5' of the reverse complement of the second coding sequence. Optionally, the first polyadenylation signal sequence is different from the second polyadenylation signal sequence.

In some such constructs, the nucleic acid construct does not comprise a promoter that drives expression of the first retinoschisin protein or fragment thereof or the second retinoschisin protein or fragment thereof. In some such constructs, the first segment comprises a first splice acceptor site located 5' of the first coding sequence, and the second segment comprises a reverse complement of a second splice acceptor site located 3' of the reverse complement of the second coding sequence. Optionally, the first splice acceptor site is from an RS1 gene, the second splice acceptor site is from an RS1 gene, or both the first splice acceptor site and the second splice acceptor site are from an RS1 gene. Optionally, the first splice acceptor site is from intron 1 of human RS1, the second splice acceptor site is from intron 1 of human RS1, or both the first acceptor site and the second splice acceptor site are from intron 1 of human RS1.

In some such constructs, the nucleic acid construct does not comprise a homology arm. In some such constructs, the nucleic acid construct comprises homology arms. In some such constructs, the nucleic acid construct is single-stranded. In some such constructs, the nucleic acid construct is double-stranded. In some such constructs, the nucleic acid construct comprises DNA.

In some such constructs, the first coding sequence is codon-optimized for expression in a host cell, the second coding sequence is codon-optimized for expression in the host cell, or both the first coding sequence and the second coding sequence are codon-optimized for expression in the host cell. In some such constructs, the nucleic acid construct comprises one or more of the following terminal structures: hairpin, loop, inverted terminal repeat (ITR), or toroid. Optionally, the nucleic acid construct comprises ITRs.

In some such constructs, the first retinoschisin protein or fragment thereof and/or the second retinoschisin protein or fragment thereof comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 5. In some such constructs, the first coding sequence and/or the second coding sequence comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 8 or 9. In some such constructs, the first coding sequence comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 8, and the second coding sequence comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 9. In some such constructs, the nucleic acid construct comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 46 or 47.

In some such constructs, the second segment is located 3' of the first segment, both the first retinoschisin protein or fragment thereof and the second retinoschisin protein or fragment thereof are a human retinoschisin protein or fragment thereof, the first retinoschisin protein or fragment thereof is identical to the second retinoschisin protein or fragment thereof, both the first coding sequence and the second coding sequence comprise complementary DNA (cDNA) comprising exons 2-6 of human RS1 or degenerate variants thereof, the second coding sequence adopts a different codon usage from the codon usage of the first coding sequence, the first segment comprises a first polyadenylation signal sequence located 3' of the first coding sequence, and the second segment comprises a reverse complement of a second polyadenylation signal sequence located 5' of the reverse complement of the second coding sequence, the first segment comprises a first splice acceptor site located 5' of the first coding sequence, and the second segment comprises a reverse complement of a second splice acceptor site located 3' of the reverse complement of the second coding sequence, the nucleic acid construct does not comprise a promoter that drives expression of the first retinoschisin protein or fragment thereof or the second retinoschisin protein or fragment thereof, and the nucleic acid construct does not comprise a homology arm.

In another aspect, provided are vectors comprising any of the above bidirectional nucleic acid constructs. Some such vectors are viral vectors. Optionally, the vector is an adeno-associated virus (AAV) vector. Optionally, the AAV comprises a single-stranded genome (ssAAV). Optionally, the AAV comprises a self-complementary genome (scAAV). Optionally, the AAV is selected from the group consisting of: AAV2, AAV5, AAV8, or AAV7m8.

Some such vectors do not comprise a promoter that drives expression of the first retinoschisin protein or fragment thereof or the second retinoschisin protein or fragment thereof. Some such vectors do not comprise a homology arm. Some such vectors do comprise homology arms.

In another aspect, provided are lipid nanoparticles comprising any of the above bidirectional nucleic acid constructs.

In another aspect, provided are cells comprising any of the above bidirectional nucleic acid constructs. Some such cells are in vitro. Some such cells are in vivo. Some such cells are mammalian cells. Some such cells are human cells. Some such cells are retinal cells.

Some such cells express the first retinoschisin protein or fragment thereof or the second retinoschisin protein or fragment thereof. In some such cells, the nucleic acid construct is genomically integrated at the target genomic locus. In some such cells, the target genomic locus is an endogenous RS1 locus. Optionally, the nucleic acid construct is genomically integrated in intron 1 of the endogenous RS1 locus. Optionally, endogenous RS1 exon 1 splices into the first coding sequence or the second coding sequence of the nucleic acid construct. Optionally, the modified RS1 locus comprising the genomically integrated nucleic acid construct encodes a protein comprising, consisting essentially of, or consisting of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 2 or 4.

In some such cells, integration of the nucleic acid construct into the endogenous RS1 locus prevents transcription of the endogenous RS1 gene downstream of the integration site. Optionally, the integration of the nucleic acid construct into the endogenous RS1 locus reduces or eliminates expression of the endogenous retinoschisin protein and replaces it with expression of the retinoschisin protein or fragment thereof encoded by the nucleic acid construct. Optionally, the endogenous RS1 locus comprises a mutated RS1 gene comprising a mutation that causes X-linked juvenile retinoschisis, and expression of the genomically integrated nucleic acid construct reduces or eliminates expression of the mutated RS1 gene.

In another aspect, provided are nucleic acid constructs for homology-independent targeted integration into a target genomic locus. Some such nucleic acid constructs comprise a coding sequence for a retinoschisin protein or fragment thereof flanked on each side by a nuclease target sequence for a nuclease agent. Also provided are nucleic acid constructs for homologous recombination with a target locus. Some such nucleic acid constructs comprise a coding sequence for a retinoschisin protein or fragment thereof flanked by homology arms on each side, optionally wherein the coding sequence and homology arms are further flanked on each side by a target sequence for a nuclease agent. Optionally, each homology arm is between about 25 nucleotides and about 2.5 kb in length.

In some such constructs for homology-independent targeted integration, the nuclease target sequence in the nucleic acid construct is identical to a nuclease target sequence for integration into the target genomic locus, wherein the nuclease target sequence in the target genomic locus is destroyed if the nucleic acid construct is inserted in the correct orientation but is reformed if the nucleic acid construct is inserted into the target genomic locus in the opposite orientation.

In some such constructs, the retinoschisin protein or fragment thereof is a human retinoschisin protein or fragment thereof. In some such constructs, the coding sequence for the retinoschisin protein or fragment thereof comprises, consists essentially of, or consists of complementary DNA (cDNA). In some such constructs, the coding sequence for the retinoschisin protein or fragment thereof comprises, consists essentially of, or consists of exons 2-6 of human RS1 or degenerate variants thereof.

In some such constructs, the nucleic acid construct comprises a fragment or portion of the first intron of human RS1 located 5' of the coding sequence. In some such constructs, the nucleic acid construct does not comprise a promoter that drives expression of the retinoschisin protein or fragment thereof. In some such constructs, the nucleic acid construct comprises a polyadenylation signal sequence located 3' of the coding sequence. In some such constructs, the nucleic acid construct comprises a splice acceptor site located 5' of the coding sequence. Optionally, the splice acceptor site is from an RS1 gene. Optionally, the splice acceptor site is from intron 1 of human RS1.

Some such constructs are single-stranded. Some such constructs are double-stranded. Some such constructs comprise DNA. In some such constructs, the coding sequence is codon-optimized for expression in a host cell.

In some such constructs, the construct comprises one or more of the following terminal structures: hairpin, loop, inverted terminal repeat (ITR), or toroid. Optionally, the nucleic acid construct comprising the coding sequence and the nuclease target sequences is flanked by ITRs.

In some such constructs, the nuclease agent is a Cas protein and a guide RNA, and the nuclease target sequence is a guide RNA target sequence. Optionally, the guide RNA target sequence is an inverted guide RNA target sequence. Optionally, the Cas protein is Cas9.

In some such constructs, the retinoschisin protein or fragment thereof comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 5. In some such constructs, the coding sequence for the retinoschisin protein or fragment thereof comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 8 or 9. In some such constructs, the nucleic acid construct comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 45.

In some such constructs, the nucleic acid construct is the nucleic acid construct for homology-independent targeted integration into the target genomic locus, the retinoschisin protein or fragment thereof is a human retinoschisin protein or fragment thereof, the coding sequence for the retinoschisin protein or fragment thereof comprises complementary DNA (cDNA) comprising exons 2-6 of human RS1 or degenerate variants thereof, the nucleic acid construct does not comprise a promoter that drives expression of the retinoschisin protein or fragment thereof, the nucleic acid construct comprises a polyadenylation signal sequence located 3' of the coding sequence, the nucleic acid construct comprises a splice acceptor site located 5' of the coding sequence, and the nuclease target sequence in the nucleic acid construct is identical to a nuclease target sequence for integration into the target genomic locus, wherein the nuclease target sequence in the target genomic locus is destroyed if the nucleic acid construct is inserted in the correct orientation but is reformed if the nucleic acid construct is inserted into the target genomic locus in the opposite orientation.

In some such constructs, the nucleic acid construct is the nucleic acid construct for homologous recombination with the target genomic locus, the retinoschisin protein or fragment thereof is a human retinoschisin protein or fragment thereof, the coding sequence for the retinoschisin protein or fragment thereof comprises complementary DNA (cDNA) comprising exons 2-6 of human RS1 or degenerate variants thereof, the nucleic acid construct does not comprise a promoter that drives expression of the retinoschisin protein or fragment thereof, the nucleic acid construct comprises a polyadenylation signal sequence located 3' of the coding sequence, the nucleic acid construct comprises a splice acceptor site located 5' of the coding sequence, and each homology arm is between about 25 nucleotides and about 2.5 kb in length.

In another aspect, provided are vectors comprising any of the above nucleic acid constructs for homology-independent targeted integration. Some such vectors are viral vectors. Some such vectors are adeno-associated virus (AAV) vectors. Optionally, the AAV comprises a single-stranded genome (ssAAV). Optionally, the AAV comprises a self-complementary genome (scAAV). Optionally, the AAV is selected from the group consisting of: AAV2, AAV5, AAV8, or AAV7m8.

In some such vectors, the vector does not comprise a promoter that drives expression of the retinoschisin protein or fragment thereof. In some such vectors, the vector does not comprise a homology arm.

In another aspect, provided are lipid nanoparticles comprising any of the above nucleic acid constructs for homology-independent targeted integration.

In another aspect, provided are cells comprising any of the above nucleic acid constructs for homology-independent targeted integration. Some such cells are in vitro. Some such cells are in vivo. Some such cells are mammalian cells. Some such cells are human cells. Some such cells are retinal cells.

In some such cells, the cell expresses the retinoschisin protein or fragment thereof. In some such cells, the nucleic acid construct is genomically integrated at the target genomic locus. Optionally, the target genomic locus is an endogenous RS1 locus. Optionally, the nucleic acid construct is genomically integrated in intron 1 of the endogenous RS1 locus. Optionally, endogenous RS1 exon 1 splices into the coding sequence for the retinoschisin protein or fragment thereof in the nucleic acid construct. Optionally, the modified RS1 locus comprising the genomically integrated nucleic acid construct encodes a protein comprising, consisting essentially of, or consisting of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 2 or 4.

In some such cells, integration of the nucleic acid construct into the endogenous RS1 locus prevents transcription of the endogenous RS1 gene downstream of the integration site. Optionally, the integration of the nucleic acid construct into the endogenous RS1 locus reduces or eliminates expression of the endogenous retinoschisin protein and replaces it with expression of the retinoschisin protein or fragment thereof encoded by the nucleic acid construct. Optionally, the endogenous RS1 locus comprises a mutated RS1 gene comprising a mutation that causes X-linked juvenile retinoschisis, and expression of the genomically integrated nucleic acid construct reduces or eliminates expression of the mutated RS1 gene.

In another aspect, provided are compositions for use in expressing retinoschisin in a cell or for use in integrating a coding sequence for a retinoschisin protein or fragment thereof into a target genomic locus in a cell. Some such compositions comprise: (a) a nucleic acid construct comprising the coding sequence for the retinoschisin protein or fragment thereof for integration into the target genomic locus; and (b) a nuclease agent or a nucleic acid encoding the nuclease agent, wherein the nuclease agent targets a nuclease target sequence in the target genomic locus.

Some such compositions comprise: (a) any of the above nucleic acid constructs for homology-independent targeted integration; and (b) a nuclease agent or a nucleic acid encoding the nuclease agent, wherein the nuclease agent targets a nuclease target sequence in the target genomic locus. Optionally, the nuclease target sequence in the target genomic locus is identical to the nuclease target sequence in the nucleic acid construct. Optionally, the nuclease target sequence in the target genomic locus is destroyed if the nucleic acid construct is inserted in the correct orientation but is reformed if the nucleic acid construct is inserted into the target genomic locus in the opposite orientation.

Some such compositions comprise: (a) any of the above bidirectional nucleic acid constructs; and (b) a nuclease agent or a nucleic acid encoding the nuclease agent, wherein the nuclease agent targets a nuclease target sequence in the target genomic locus.

In some such compositions, the target genomic locus is in an RS1 gene. Optionally, the nuclease target sequence in the target genomic locus is in the first intron in the RS1 gene. Optionally, integration of the nucleic acid construct into the endogenous RS1 locus prevents transcription of the endogenous RS1 gene downstream of the integration site. Optionally, the integration of the nucleic acid construct into the endogenous RS1 locus in the cell reduces or eliminates expression of the endogenous retinoschisin protein and replaces it with expression of the retinoschisin protein or fragment thereof encoded by the nucleic acid construct.

In some such compositions, the nuclease agent is a Cas protein and a guide RNA, and the nuclease target sequence is a guide RNA target sequence. Optionally, the Cas protein is Cas9. Optionally, the composition comprises the guide RNA and a messenger RNA encoding the Cas protein. Optionally, the guide RNA and the messenger RNA encoding the Cas protein are in a lipid nanoparticle. Optionally, the composition comprises a DNA encoding the Cas protein and a DNA encoding the guide RNA. Optionally, the DNA encoding the Cas protein and the DNA encoding the guide RNA are in one or more viral vectors. Optionally, the one or more viral vectors are adeno-associated virus (AAV) viral vectors. Optionally, the DNA encoding the Cas protein and the DNA encoding the guide RNA are in a single viral vector (e.g., a single AAV vector). Optionally, the DNA encoding the Cas protein and the DNA encoding the guide RNA are in a separate viral vectors (e.g., a separate AAV vectors).

In some such compositions, the nucleic acid construct is in a viral vector. Optionally, the viral vector is an adeno-associated virus (AAV) viral vector. Optionally, the AAV is selected from the group consisting of: AAV2, AAV5, AAV8, or AAV7m8.

Also provided are compositions comprising a guide RNA or a DNA encoding the guide RNA, wherein the guide RNA comprises a DNA-targeting segment that targets a guide RNA target sequence in an RS1 gene, and wherein the guide RNA binds to a Cas protein and targets the Cas protein to the guide RNA target sequence in the RS1 gene.

In some such compositions or compositions for use, the composition further comprises the Cas protein or a nucleic acid encoding the Cas protein. Optionally, the Cas protein is a Cas9 protein. Optionally, the Cas protein is derived from a *Streptococcus pyogenes* Cas9 protein. In some such compositions or compositions for use, the composition comprises the Cas protein in the form of a protein.

In some such compositions or compositions for use, the composition comprises the nucleic acid encoding the Cas protein, wherein the nucleic acid comprises a DNA encoding the Cas protein, optionally wherein the composition comprises the DNA encoding the guide RNA. Optionally, the composition comprises the nucleic acid encoding the Cas protein, wherein the nucleic acid comprises a DNA encoding the Cas protein, wherein the composition comprises the DNA encoding the guide RNA, and wherein the DNA encoding the Cas protein and the DNA encoding the guide RNA are in one or more viral vectors. Optionally, the one or more viral vectors are adeno-associated virus (AAV) viral vectors. Optionally, the DNA encoding the Cas protein and the DNA encoding the guide RNA are in a single viral vector (e.g., a single AAV vector). Optionally, the DNA encoding the Cas protein and the DNA encoding the guide RNA are in a separate viral vectors (e.g., a separate AAV vectors). Optionally, the AAV is selected from the group consisting of: AAV2, AAV5, AAV8, or AAV7m8.

In some such compositions or compositions for use, the composition comprises the nucleic acid encoding the Cas protein, wherein the nucleic acid comprises a messenger RNA encoding the Cas protein, optionally wherein the composition comprises the guide RNA in the form of RNA. In some such compositions or compositions for use, the composition comprises the nucleic acid encoding the Cas protein, wherein the nucleic acid comprises a messenger RNA encoding the Cas protein, wherein the composition comprises the guide RNA in the form of RNA, and wherein the guide RNA and the messenger RNA encoding the Cas protein are in a lipid nanoparticle.

In some such compositions or compositions for use, the messenger RNA encoding the Cas protein comprises at least one modification. Optionally, the messenger RNA encoding the Cas protein is modified to comprise a modified uridine at one or more or all uridine positions. Optionally, the modified uridine is pseudouridine. Optionally, the messenger RNA encoding the Cas protein is fully substituted with pseudouridine. In some such compositions or compositions for use, the messenger RNA encoding the Cas protein comprises a 5' cap. In some such compositions or compositions for use, the messenger RNA encoding the Cas protein comprises a poly(A) tail. In some such compositions or compositions for use, the messenger RNA encoding the Cas protein comprises the sequence set forth in SEQ ID NO: 6243 or 6245.

In some such compositions or compositions for use, the nucleic acid encoding the Cas protein is codon-optimized for expression in a mammalian cell or a human cell. In some such compositions or compositions for use, the Cas protein comprises the sequence set forth in SEQ ID NO: 27, 6242, or 6246.

In some such compositions or compositions for use, the guide RNA target sequence is in an intron of the RS1 gene. Optionally, the intron is the first intron of the RS1 gene.

In some such compositions or compositions for use, the RS1 gene is a human RS1 gene.

In some such compositions or compositions for use, the DNA-targeting segment comprises: (a) at least 17, at least 18, at least 19, or at least 20 contiguous nucleotides of the sequence set forth in any one of SEQ ID NOS: 3148-6241; (b) at least 17, at least 18, at least 19, or at least 20 contiguous nucleotides of the sequence set forth in any one of SEQ ID NOS: 3148-4989; (c) at least 17, at least 18, at least 19, or at least 20 contiguous nucleotides of the sequence set forth in any one of SEQ ID NOS: 3148-3151, 3154-3186, 3188-3247, and 3249-4351; (d) at least 17, at least 18, at least 19, or at least 20 contiguous nucleotides of the sequence set forth in any one of SEQ ID NOS: 3150, 3151, 3159, 3675, 4297, and 4304; or (e) at least 17, at least 18, at least 19, or at least 20 contiguous nucleotides of the sequence set forth in any one of SEQ ID NOS: 4990-6241.

In some such compositions or compositions for use, the DNA-targeting segment is: (a) at least 90%, at least 91%, at least 92%, at least 93%, at least 94%, at least 95%, at least 96%, at least 97%, at least 98%, or at least 99% identical to the sequence set forth in any one of SEQ ID NOS: 3148-6241; (b) at least 90%, at least 91%, at least 92%, at least 93%, at least 94%, at least 95%, at least 96%, at least 97%, at least 98%, or at least 99% identical to the sequence set forth in any one of SEQ ID NOS: 3148-4989; (c) at least 90%, at least 91%, at least 92%, at least 93%, at least 94%, at least 95%, at least 96%, at least 97%, at least 98%, or at least 99% identical to the sequence set forth in any one of SEQ ID NOS: 3148-3151, 3154-3186, 3188-3247, and 3249-4351; (d) at least 90%, at least 91%, at least 92%, at least 93%, at least 94%, at least 95%, at least 96%, at least 97%, at least 98%, or at least 99% identical to the sequence set forth in any one of SEQ ID NOS: 3150, 3151, 3159, 3675, 4297, and 4304; or (e) at least 90%, at least 91%, at least 92%, at least 93%, at least 94%, at least 95%, at least 96%, at least 97%, at least 98%, or at least 99% identical to the sequence set forth in any one of SEQ ID NOS: 4990-6241.

In some such compositions or compositions for use, the DNA-targeting segment comprises, consists essentially of, or consists of the sequence set forth in: (a) any one of SEQ ID NOS: 3148-6241; (b) any one of SEQ ID NOS: 3148-4989; (c) any one of SEQ ID NOS: 3148-3151, 3154-3186, 3188-3247, and 3249-4351; (d) any one of SEQ ID NOS: 3150, 3151, 3159, 3675, 4297, and 4304; or (e) any one of SEQ ID NOS: 4990-6241.

In some such compositions or compositions for use, the DNA-targeting segment comprises at least 17, at least 18, at least 19, or at least 20 contiguous nucleotides of the sequence set forth in any one of SEQ ID NOS: 3150, 3151, 3159, 3675, 4297, and 4304.

In some such compositions or compositions for use, the DNA-targeting segment is at least 90%, at least 91%, at least 92%, at least 93%, at least 94%, at least 95%, at least 96%, at least 97%, at least 98%, or at least 99% identical to the sequence set forth in any one of SEQ ID NOS: 3150, 3151, 3159, 3675, 4297, and 4304.

In some such compositions or compositions for use, the DNA-targeting segment comprises, consists essentially of, or consist of the sequence set forth in any one of SEQ ID NOS: 3150, 3151, 3159, 3675, 4297, and 4304.

In some such compositions or compositions for use, the composition comprises the guide RNA in the form of RNA. In some such compositions or compositions for use, the composition comprises the DNA encoding the guide RNA.

In some such compositions or compositions for use, the guide RNA comprises at least one modification. In some such compositions or compositions for use, the at least one modification comprises a 2'-O-methyl-modified nucleotide. In some such compositions or compositions for use, the at least one modification comprise a phosphorothioate bond between nucleotides. In some such compositions or compositions for use, the at least one modification comprise a modification at one or more of the first five nucleotides at the 5' end of the guide RNA. In some such compositions or compositions for use, the at least one modification comprises a modification at one or more of the last five nucleotides at the 3' end of the guide RNA. In some such compositions or compositions for use, the at least one modification comprises phosphorothioate bonds between the first four nucleotides at the 5' end of the guide RNA. In some such compositions or compositions for use, the at least one modification comprises phosphorothioate bonds between the last four nucleotides at the 3' end of the guide RNA. In some such compositions or compositions for use, the at least one modification comprises 2'-O-methyl-modified nucleotides at the first three nucleotides at the 5' end of the guide RNA. In some such compositions or compositions for use, the at least one modification comprises 2'-O-methyl-modified nucleotides at the last three nucleotides at the 3' end of the guide RNA. In some such compositions or compositions for use, the at least one modification comprises: (i) phosphorothioate bonds between the first four nucleotides at the 5' end of the guide RNA; (ii) phosphorothioate bonds between the last four nucleotides at the 3' end of the guide RNA; (iii) 2'-O-methyl-modified nucleotides at the first three nucleotides at the 5' end of the guide RNA; and (iv) 2'-O-methyl-modified nucleotides at the last three nucleotides at the 3' end of the guide RNA. In some such compositions or compositions for use, the guide RNA comprises the modified nucleotides of SEQ ID NO: 44.

In some such compositions or compositions for use, the guide RNA is a single guide RNA (sgRNA). Optionally, the guide RNA comprises, consists essentially of, or consists of the sequence set forth in any one of SEQ ID NOS: 33-39 and 53. In some such compositions or compositions for use, the guide RNA is a dual guide RNA (dgRNA) comprising two separate RNA molecules comprising a CRISPR RNA (crRNA) and a trans-activating crRNA (tracrRNA). Optionally, the crRNA comprises the sequence set forth in any one of SEQ ID NOS: 29 and 52. Optionally, the tracrRNA comprises the sequence set forth in any one of SEQ ID NOS: 30-32.

In some such compositions or compositions for use, the composition is associated with a lipid nanoparticle, optionally wherein the composition comprises the guide RNA. In some such compositions or compositions for use, the DNA encoding the guide RNA is in a viral vector. In some such compositions or compositions for use, the viral vector is an adeno-associated virus (AAV) viral vector. Optionally, the DNA encoding the Cas protein and the DNA encoding the guide RNA are in a single viral vector (e.g., a single AAV vector). Optionally, the DNA encoding the Cas protein and the DNA encoding the guide RNA are in a separate viral vectors (e.g., a separate AAV vectors). Optionally, the AAV is selected from the group consisting of: AAV2, AAV5, AAV8, or AAV7m8.

In some such compositions or compositions for use, the composition is a pharmaceutical composition comprising a pharmaceutically acceptable carrier.

In some such compositions or compositions for use, the composition further comprises a second guide RNA or a DNA encoding the second guide RNA, wherein the second guide RNA comprises a DNA-targeting segment that targets a second guide RNA target sequence in the RS1 gene, and wherein the second guide RNA binds to the Cas protein and targets the Cas protein to the second guide RNA target sequence in the RS1 gene.

Also provided are cells comprising any of the above compositions or compositions for use. Optionally, the cell is in vitro. Optionally, the cell is in vivo. Some such cells are mammalian cells. Optionally, the cell is a human cell. Optionally, the cell is a retinal cell.

In some such cells, the cell expresses the first retinoschisin protein or fragment thereof or the second retinoschisin protein or fragment thereof. In some such cells, the nucleic acid construct is genomically integrated at the target genomic locus. Optionally, the target genomic locus is an endogenous RS1 locus. Optionally, the nucleic acid construct is genomically integrated in intron 1 of the endogenous RS1 locus. Optionally, endogenous RS1 exon 1 splices into the first coding sequence or the second coding sequence of the nucleic acid construct. Optionally, the modified RS1 locus comprising the genomically integrated nucleic acid construct encodes a protein comprising, consisting essentially of, or consisting of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 2 or 4.

In some such cells, integration of the nucleic acid construct into the endogenous RS1 locus prevents transcription of the endogenous RS1 gene downstream of the integration site. Optionally, the integration of the nucleic acid construct into the endogenous RS1 locus reduces or eliminates expression of the endogenous retinoschisin protein and replaces it with expression of the retinoschisin protein or fragment thereof encoded by the nucleic acid construct. Optionally, the endogenous RS1 locus comprises a mutated RS1 gene comprising a mutation that causes X-linked juvenile retinoschisis, and expression of the genomically integrated nucleic acid construct reduces or eliminates expression of the mutated RS1 gene.

In another aspect, provided are methods of integrating a coding sequence for a retinoschisin protein or fragment thereof into a target genomic locus and expressing the retinoschisin protein or fragment thereof in a cell. Some such methods comprise administering any of the above nucleic acid constructs, vectors, lipid nanoparticles, or compositions to the cell, wherein the coding sequence is integrated into the target genomic locus and the retinoschisin protein or fragment thereof is expressed in the cell. Optionally, the cell is a mammalian cell. Optionally, the cell is a human cell. Optionally, the cell is a retinal cell. Optionally, the cell is in vitro. Optionally, the cell is in vivo. Optionally, the cell is a retinal cell in vivo, and the administering comprises subretinal injection or intravitreal injection.

In some such methods, the nucleic acid construct and the nuclease agent or the nucleic acid encoding the nuclease agent are administered simultaneously. In some such methods, the nucleic acid construct and the nuclease agent or the nucleic acid encoding the nuclease agent are administered sequentially in any order. Optionally, the nucleic acid construct is administered prior to the nuclease agent or the nucleic acid encoding the nuclease agent. Optionally, the nucleic acid construct is administered subsequent to the nuclease agent or the nucleic acid encoding the nuclease agent. Optionally, the time between the sequential administration is about 2 hours to about 48 hours. In some such methods, the nucleic acid construct and the nuclease agent or the nucleic acid encoding the nuclease agent are administered in the same delivery vehicle. In some such methods, the nucleic acid construct and the nuclease agent or the nucleic acid encoding the nuclease agent are administered in different delivery vehicles.

In some such methods, the target genomic locus is in an endogenous RS1 gene. Optionally, the nuclease target sequence in the target genomic locus is in the first intron in the endogenous RS1 gene. Optionally, the nucleic acid construct is genomically integrated in intron 1 of the endogenous RS1 locus, and wherein endogenous RS1 exon 1 splices into the coding sequence for the retinoschisin protein or fragment thereof in the nucleic acid construct. Optionally, the modified RS1 locus comprising the genomically integrated nucleic acid construct encodes a protein comprising, consisting essentially of, or consisting of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 2 or 4. In some such methods, integration of the nucleic acid construct into the endogenous RS1 locus prevents transcription of the endogenous RS1 gene downstream of the integration site. Optionally, the integration of the nucleic acid construct into the endogenous RS1 locus reduces or eliminates expression of the endogenous retinoschisin protein from the endogenous RS1 locus and replaces it with expression of the retinoschisin protein or fragment thereof encoded by the nucleic acid construct.

In another aspect, provided are methods of treating a subject with X-linked juvenile retinoschisis. Some such methods can comprise administering any of the above nucleic acid constructs, vectors, lipid nanoparticles, or compositions to the subject, wherein the nucleic acid construct is integrated into and expressed from the target genomic locus in one or more retinal cells of the subject, and wherein a therapeutically effective level of retinoschisin expression is achieved in the subject. In some such methods, the subject is a human. In some such methods, the subject has an endogenous RS1 gene comprising at least one mutation associated with or that causes X-linked juvenile retinoschisis. Optionally, the mutation is a R141C mutation. In some such methods, the administering comprises subretinal injection or intravitreal injection. In some such methods, integration of the nucleic acid construct results in retinal structural restoration.

In some such methods, the nucleic acid construct and the nuclease agent or the nucleic acid encoding the nuclease agent are administered simultaneously. In some such methods, the nucleic acid construct and the nuclease agent or the nucleic acid encoding the nuclease agent are administered sequentially in any order. Optionally, the nucleic acid construct is administered prior to the nuclease agent or the nucleic acid encoding the nuclease agent. Optionally, the nucleic acid construct is administered subsequent to the nuclease agent or the nucleic acid encoding the nuclease agent. Optionally, the time between the sequential administration is about 2 hours to about 48 hours. In some such methods, the nucleic acid construct and the nuclease agent or the nucleic acid encoding the nuclease agent are administered in the same delivery vehicle. In some such methods, the nucleic acid construct and the nuclease agent or the nucleic acid encoding the nuclease agent are administered in different delivery vehicles.

In some such methods, the target genomic locus is in an endogenous RS1 gene. Optionally, the nuclease target sequence in the target genomic locus is in the first intron in the endogenous RS1 gene. Optionally, the nucleic acid construct is genomically integrated in intron 1 of the endogenous RS1 locus, and wherein endogenous RS1 exon 1 splices into the coding sequence for the retinoschisin protein or fragment thereof in the nucleic acid construct. Optionally, the modified RS1 locus comprising the genomically integrated nucleic acid construct encodes a protein comprising, consisting essentially of, or consisting of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 2 or 4. In some such methods, integration of the nucleic acid construct into the endogenous RS1 locus prevents transcription of the endogenous RS1 gene downstream of the integration site. Optionally, the integration of the nucleic acid construct into the endogenous RS1 locus reduces or eliminates expression of the endogenous retinoschisin protein from the endogenous RS1 locus and replaces it with expression of the retinoschisin protein or fragment thereof encoded by the nucleic acid construct.

In another aspect, provided are methods of modifying an RS1 gene in a cell. Some such methods comprise administering to the cell any of the above compositions comprising the guide RNA or the DNA encoding the guide RNA and the Cas protein or the nucleic acid encoding the Cas protein, wherein the guide RNA binds to the Cas protein and targets the Cas protein to the guide RNA target sequence in the RS1 gene, and the Cas protein cleaves the guide RNA target sequence. In some such methods, the cell is a mammalian cell. Optionally, the cell is a human cell. Optionally, the cell is a retinal cell. Optionally, the cell is in vitro. Optionally, the cell is in vivo. In some such methods, the cell is a retinal cell, and the administering comprises subretinal injection or intravitreal injection. In some such methods, the guide RNA target sequence is in the first intron in the RS1 gene.

BRIEF DESCRIPTION OF THE FIGURES

FIG. 5 shows NGS results from mouse retina samples in eyes from $Rosa^{Cas9}/+$. $Rs1^{R141C/Y}$ mice injected with RS1 viral vector version 1 (pssAAV mhRS1-sgu), RS1 viral vector version 2 (pscAAV rs1_tandem), or RSJ viral vector version 3 (pssAAV hRs1_HITI). Read counts for the four expected sequence variants are shown: (1) WT mouse, the mouse reference sequence not containing the R141C mutant; (2) mutant mouse, the mouse reference sequence harboring the R141C mutant; (3) humanized transcript 1, the human reference sequence; and (4) humanized transcript 2, the mouse codon-optimized human reference sequence. Next generation targeted resequencing amplicons were designed for the regions depicted in FIG. 3 (horizontal arrows). mRNA from the mouse retinas was used to generate cDNA to act as a template for next generation sequencing (NGS) amplification.

FIGS. 6A and 6B show NGS results from mouse retina samples in eyes from $Rosa^{Cas9}/+$; $Rs1^{R141C/Y}$ mice injected with RS1 viral vector version 1 (mhRS1-sgu), RS1 viral vector version 2 (pscAAV_rs1_tandem), or RS1 viral vector version 3 (hRs1_cDNA HITI). For these NGS results, a separate amplicon was used to amplify the Rs1 intron 1 guide RNA target sequence. Reads that matched the mouse reference sequence or contained non-homologous end joining were quantified to assess how often the guide RNA cut without making an insertion.

FIG. 7A), RS1 viral vector version 2 (pscAAV rs1_tandem; FIG. 7B), or RS1 viral vector version 3 (pssAAV hRs1_HITI; FIG. 7C). Read counts for the four expected sequence variants are shown: (1) WT mouse, the mouse reference sequence not containing the R141C mutant; (2) mutant mouse, the mouse reference sequence harboring the R141C mutant; (3) humanized transcript 1, the human reference sequence; and (4) humanized transcript 2, the mouse codon-optimized human reference sequence. Next generation targeted resequencing amplicons were designed for the regions depicted in FIG. 3 (horizontal arrows). mRNA from the mouse retinas was used to generate cDNA to act as a template for next generation sequencing (NGS) amplification. Reads that matched the mouse reference sequence or contained non-homologous end joining were quantified to assess how often the guide RNA cut without making an insertion.

FIG. 8A) or RS1 viral vector version 2 (pscAAV rs1_tandem; FIG. 8B) two hours before treatment with lipid nanoparticles formulated with Cas9 mRNA and one of six guide RNAs targeted to human RS1 intron 1. Delta Ct values are shown (the lower the number, the higher the expression). "Ho" refers to human reference sequence, and "Mo" refers to human reference sequence codon-optimized for mouse expression.

FIG. 9A) or RS1 viral vector version 2 (pscAAV rs1_tandem; FIG. 9B) two hours after treatment with lipid nanoparticles formulated with Cas9 mRNA and one of six guide RNAs targeted to human RS1 intron 1. Delta Ct values are shown (the lower the number, the higher the expression). "Ho" refers to human reference sequence, and "Mo" refers to human reference sequence codon-optimized for mouse expression.

DEFINITIONS

Figure 1:
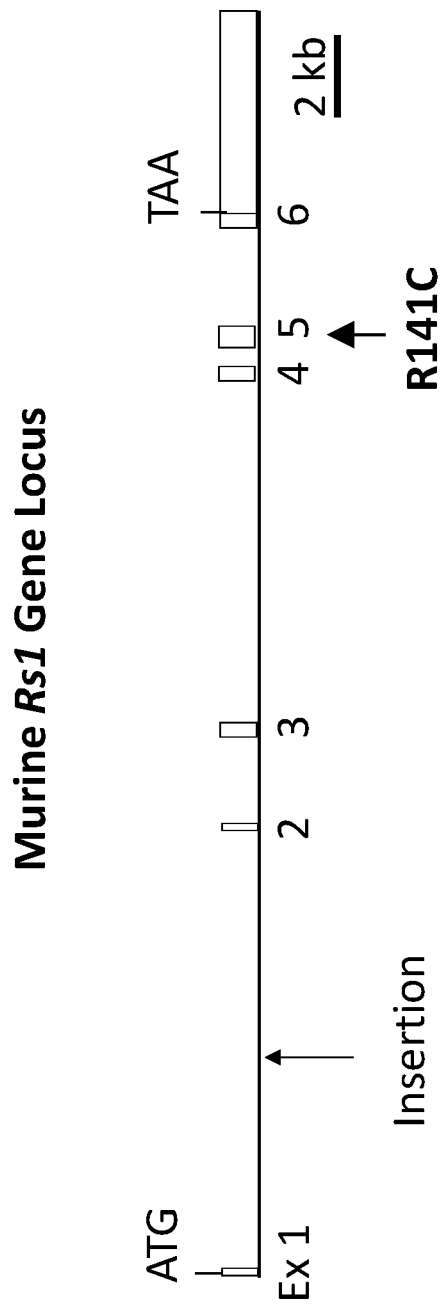
FIG. 1 (not to scale) shows a schematic of the murine Rs1 locus, including the location of the R141C mutation associated with X-linked juvenile retinoschisis (XLRS) and the insertion site for a nucleic acid construct comprising exons 2-6 of human RS1.

The terms "protein," "polypeptide," and "peptide," used interchangeably herein, include polymeric forms of amino acids of any length, including coded and non-coded amino acids and chemically or biochemically modified or derivatized amino acids. The terms also include polymers that have been modified, such as polypeptides having modified peptide backbones. The term "domain" refers to any part of a protein or polypeptide having a particular function or structure.

The terms "nucleic acid" and "polynucleotide," used interchangeably herein, include polymeric forms of nucleotides of any length, including ribonucleotides, deoxyribonucleotides, or analogs or modified versions thereof. They include single-, double-, and multi-stranded DNA or RNA, genomic DNA, cDNA, DNA-RNA hybrids, and polymers comprising purine bases, pyrimidine bases, or other natural, chemically modified, biochemically modified, non-natural, or derivatized nucleotide bases.

The term "genomically integrated" refers to a nucleic acid that has been introduced into a cell such that the nucleotide sequence integrates into the genome of the cell. Any protocol may be used for the stable incorporation of a nucleic acid into the genome of a cell.

The term "expression vector" or "expression construct" or "expression cassette" refers to a recombinant nucleic acid containing a desired coding sequence operably linked to appropriate nucleic acid sequences necessary for the expression of the operably linked coding sequence in a particular host cell or organism. Nucleic acid sequences necessary for expression in prokaryotes usually include a promoter, an operator (optional), and a ribosome binding site, as well as other sequences. Eukaryotic cells are generally known to utilize promoters, enhancers, and termination and polyadenylation signals, although some elements may be deleted and other elements added without sacrificing the necessary expression.

The term "viral vector" refers to a recombinant nucleic acid that includes at least one element of viral origin and includes elements sufficient for or permissive of packaging into a viral vector particle. The vector and/or particle can be utilized for the purpose of transferring DNA, RNA, or other nucleic acids into cells either ex vivo or in vivo. Numerous forms of viral vectors are known.

The term "isolated" with respect to proteins, nucleic acids, and cells includes proteins, nucleic acids, and cells that are relatively purified with respect to other cellular or organism components that may normally be present in situ, up to and including a substantially pure preparation of the protein, nucleic acid, or cell. The term "isolated" may include proteins and nucleic acids that have no naturally occurring counterpart or proteins or nucleic acids that have been chemically synthesized and are thus substantially uncontaminated by other proteins or nucleic acids. The term "isolated" may include proteins, nucleic acids, or cells that have been separated or purified from most other cellular components or organism components with which they are naturally accompanied (e.g., but not limited to, other cellular proteins, nucleic acids, or cellular or extracellular components).

The term "wild type" includes entities having a structure and/or activity as found in a normal (as contrasted with mutant, diseased, altered, or so forth) state or context. Wild type genes and polypeptides often exist in multiple different forms (e.g., alleles).

The term "endogenous sequence" refers to a nucleic acid sequence that occurs naturally within a cell or animal. For example, an endogenous RS1 sequence of an animal refers to a native RS1 sequence that naturally occurs at the RS1 locus in the animal.

"Exogenous" molecules or sequences include molecules or sequences that are not normally present in a cell in that form. Normal presence includes presence with respect to the particular developmental stage and environmental conditions of the cell. An exogenous molecule or sequence, for example, can include a mutated version of a corresponding endogenous sequence within the cell, such as a humanized version of the endogenous sequence, or can include a sequence corresponding to an endogenous sequence within the cell but in a different form (i.e., not within a chromosome). In contrast, endogenous molecules or sequences include molecules or sequences that are normally present in that form in a particular cell at a particular developmental stage under particular environmental conditions.

The term "heterologous" when used in the context of a nucleic acid or a protein indicates that the nucleic acid or protein comprises at least two segments that do not naturally occur together in the same molecule. For example, the term "heterologous," when used with reference to segments of a nucleic acid or segments of a protein, indicates that the nucleic acid or protein comprises two or more sub-sequences that are not found in the same relationship to each other (e.g., joined together) in nature. As one example, a "heterologous" region of a nucleic acid vector is a segment of nucleic acid within or attached to another nucleic acid molecule that is not found in association with the other molecule in nature. For example, a heterologous region of a nucleic acid vector could include a coding sequence flanked by sequences not found in association with the coding sequence in nature. Likewise, a "heterologous" region of a protein is a segment of amino acids within or attached to another peptide molecule that is not found in association with the other peptide molecule in nature (e.g., a fusion protein, or a protein with a tag). Similarly, a nucleic acid or protein can comprise a heterologous label or a heterologous secretion or localization sequence.

"Codon optimization" takes advantage of the degeneracy of codons, as exhibited by the multiplicity of three-base pair codon combinations that specify an amino acid, and generally includes a process of modifying a nucleic acid sequence for enhanced expression in particular host cells by replacing at least one codon of the native sequence with a codon that is more frequently or most frequently used in the genes of the host cell while maintaining the native amino acid sequence. For example, a nucleic acid encoding a Cas9 protein can be modified to substitute codons having a higher frequency of usage in a given prokaryotic or eukaryotic cell, including a bacterial cell, a yeast cell, a human cell, a non-human cell, a mammalian cell, a rodent cell, a mouse cell, a rat cell, a hamster cell, or any other host cell, as compared to the naturally occurring nucleic acid sequence. Codon usage tables are readily available, for example, at the "Codon Usage Database." These tables can be adapted in a number of ways. See Nakamura et al. (2000) *Nucleic Acids Research* 28:292, herein incorporated by reference in its entirety for all purposes. Computer algorithms for codon optimization of a particular sequence for expression in a particular host are also available (see, e.g., Gene Forge).

The term "locus" refers to a specific location of a gene (or significant sequence), DNA sequence, polypeptide-encoding sequence, or position on a chromosome of the genome of an organism. For example, an "RS1 locus" may refer to the specific location of an RS1 gene, RS1 DNA sequence, retinoschisin-encoding sequence, or RS1 position on a chromosome of the genome of an organism that has been identified as to where such a sequence resides. An "RS1 locus" may comprise a regulatory element of an RS1 gene, including, for example, an enhancer, a promoter, 5' and/or 3' untranslated region (UTR), or a combination thereof.

The term "gene" refers to DNA sequences in a chromosome that may contain, if naturally present, at least one coding and at least one non-coding region. The DNA sequence in a chromosome that codes for a product (e.g., but not limited to, an RNA product and/or a polypeptide product) can include the coding region interrupted with non-coding introns and sequence located adjacent to the coding region on both the 5' and 3' ends such that the gene corresponds to the full-length mRNA (including the 5' and 3' untranslated sequences). Additionally, other non-coding sequences including regulatory sequences (e.g., but not limited to, promoters, enhancers, and transcription factor binding sites), polyadenylation signals, internal ribosome entry sites, silencers, insulating sequence, and matrix attachment regions may be present in a gene. These sequences may be close to the coding region of the gene (e.g., but not limited to, within 10 kb) or at distant sites, and they influence the level or rate of transcription and translation of the gene.

The term "allele" refers to a variant form of a gene. Some genes have a variety of different forms, which are located at the same position, or genetic locus, on a chromosome. A diploid organism has two alleles at each genetic locus. Each pair of alleles represents the genotype of a specific genetic locus. Genotypes are described as homozygous if there are two identical alleles at a particular locus and as heterozygous if the two alleles differ.

A "promoter" is a regulatory region of DNA usually comprising a TATA box capable of directing RNA polymerase II to initiate RNA synthesis at the appropriate transcription initiation site for a particular polynucleotide sequence. A promoter may additionally comprise other regions which influence the transcription initiation rate. The promoter sequences disclosed herein modulate transcription of an operably linked polynucleotide. A promoter can be active in one or more of the cell types disclosed herein (e.g., a eukaryotic cell, a non-human mammalian cell, a human cell, a rodent cell, a pluripotent cell, a one-cell stage embryo, a differentiated cell, or a combination thereof). A promoter can be, for example, a constitutively active promoter, a conditional promoter, an inducible promoter, a temporally restricted promoter (e.g., a developmentally regulated promoter), or a spatially restricted promoter (e.g., a cell-specific or tissue-specific promoter). Examples of promoters can be found, for example, in WO 2013/176772, herein incorporated by reference in its entirety for all purposes.

A constitutive promoter is one that is active in all tissues or particular tissues at all developing stages. Examples of constitutive promoters include the human cytomegalovirus immediate early (hCMV), mouse cytomegalovirus immediate early (mCMV), human elongation factor 1 alpha (hEF1α), mouse elongation factor 1 alpha (mEF1α), mouse phosphoglycerate kinase (PGK), chicken beta actin hybrid (CAG or CBh), SV40 early, and beta 2 tubulin promoters.

Examples of inducible promoters include, for example, chemically regulated promoters and physically-regulated promoters. Chemically regulated promoters include, for example, alcohol-regulated promoters (e.g., an alcohol dehydrogenase (alcA) gene promoter), tetracycline-regulated promoters (e.g., a tetracycline-responsive promoter, a tetracycline operator sequence (tetO), a tet-On promoter, or a tet-Off promoter), steroid regulated promoters (e.g., a rat glucocorticoid receptor, a promoter of an estrogen receptor, or a promoter of an ecdysone receptor), or metal-regulated promoters (e.g., a metalloprotein promoter). Physically regulated promoters include, for example temperature-regulated promoters (e.g., a heat shock promoter) and light-regulated promoters (e.g., a light-inducible promoter or a light-repressible promoter).

Tissue-specific promoters can be, for example, neuron-specific promoters, glia-specific promoters, muscle cell-specific promoters, heart cell-specific promoters, kidney cell-specific promoters, bone cell-specific promoters, endothelial cell-specific promoters, or immune cell-specific promoters (e.g., a B cell promoter or a T cell promoter).

Developmentally regulated promoters include, for example, promoters active only during an embryonic stage of development, or only in an adult cell.

"Operable linkage" or being "operably linked" includes juxtaposition of two or more components (e.g., a promoter and another sequence element) such that both components function normally and allow the possibility that at least one of the components can mediate a function that is exerted upon at least one of the other components. For example, a promoter can be operably linked to a coding sequence if the promoter controls the level of transcription of the coding sequence in response to the presence or absence of one or more transcriptional regulatory factors. Operable linkage can include such sequences being contiguous with each other or acting in trans (e.g., a regulatory sequence can act at a distance to control transcription of the coding sequence).

"Complementarity" of nucleic acids means that a nucleotide sequence in one strand of nucleic acid, due to orientation of its nucleobase groups, forms hydrogen bonds with another sequence on an opposing nucleic acid strand. The complementary bases in DNA are typically A with T and C with G. In RNA, they are typically C with G and U with A. Complementarity can be perfect or substantial/sufficient. Perfect complementarity between two nucleic acids means that the two nucleic acids can form a duplex in which every base in the duplex is bonded to a complementary base by Watson-Crick pairing. "Substantial" or "sufficient" complementary means that a sequence in one strand is not completely and/or perfectly complementary to a sequence in an opposing strand, but that sufficient bonding occurs between bases on the two strands to form a stable hybrid complex in set of hybridization conditions (e.g., salt concentration and temperature). Such conditions can be predicted by using the sequences and standard mathematical calculations to predict the Tm (melting temperature) of hybridized strands, or by empirical determination of Tm by using routine methods. Tm includes the temperature at which a population of hybridization complexes formed between two nucleic acid strands are 50% denatured (i.e., a population of double-stranded nucleic acid molecules becomes half dissociated into single strands). At a temperature below the Tm, formation of a hybridization complex is favored, whereas at a temperature above the Tm, melting or separation of the strands in the hybridization complex is favored. Tm may be estimated for a nucleic acid having a known G+C content in an aqueous 1 M NaCl solution by using, e.g., Tm=81.5+ 0.41(% G+C), although other known Tm computations consider nucleic acid structural characteristics.

Hybridization requires that the two nucleic acids contain complementary sequences, although mismatches between bases are possible. The conditions appropriate for hybridization between two nucleic acids depend on the length of the nucleic acids and the degree of complementation, variables which are well known. The greater the degree of complementation between two nucleotide sequences, the greater the value of the melting temperature (Tm) for hybrids of nucleic acids having those sequences. For hybridizations between nucleic acids with short stretches of complementarity (e.g. complementarity over 35 or fewer, 30 or fewer, 25 or fewer, 22 or fewer, 20 or fewer, or 18 or fewer nucleotides) the position of mismatches becomes important (see Sambrook et al., supra, 11.7-11.8). Typically, the length for a hybridizable nucleic acid is at least about 10 nucleotides. Illustrative minimum lengths for a hybridizable nucleic acid include at least about 15 nucleotides, at least about 20 nucleotides, at least about 22 nucleotides, at least about 25 nucleotides, and at least about 30 nucleotides. Furthermore, the temperature and wash solution salt concentration may be adjusted as necessary according to factors such as length of the region of complementation and the degree of complementation.

The sequence of polynucleotide need not be 100% complementary to that of its target nucleic acid to be specifically hybridizable. Moreover, a polynucleotide may hybridize over one or more segments such that intervening or adjacent segments are not involved in the hybridization event (e.g., a loop structure or hairpin structure). A polynucleotide (e.g., gRNA) can comprise at least 70%, at least 80%, at least 90%, at least 95%, at least 99%, or 100% sequence complementarity to a target region within the target nucleic acid sequence to which they are targeted. For example, a gRNA in which 18 of 20 nucleotides are complementary to a target region, and would therefore specifically hybridize, would represent 90% complementarity. In this example, the remaining noncomplementary nucleotides may be clustered or interspersed with complementary nucleotides and need not be contiguous to each other or to complementary nucleotides.

Percent complementarity between particular stretches of nucleic acid sequences within nucleic acids can be determined routinely using BLAST programs (basic local alignment search tools) and PowerBLAST programs (Altschul et al. (1990) *J. Mol. Biol.* 215:403-410; Zhang and Madden (1997) *Genome Res.* 7:649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489).

The methods and compositions provided herein employ a variety of different components. Some components throughout the description can have active variants and fragments. Such components include, for example, Cas proteins, CRISPR RNAs, tracrRNAs, and guide RNAs. Biological activity for each of these components is described elsewhere herein. The term "functional" refers to the innate ability of a protein or nucleic acid (or a fragment or variant thereof) to exhibit a biological activity or function. Such biological activities or functions can include, for example, the ability of a Cas protein to bind to a guide RNA and to a target DNA sequence. The biological functions of functional fragments or variants may be the same or may in fact be changed (e.g., with respect to their specificity or selectivity or efficacy) in comparison to the original molecule, but with retention of the molecule's basic biological function.

The term "variant" refers to a nucleotide sequence differing from the sequence most prevalent in a population (e.g., by one nucleotide) or a protein sequence different from the sequence most prevalent in a population (e.g., by one amino acid).

The term "fragment," when referring to a protein, means a protein that is shorter or has fewer amino acids than the full-length protein. The term "fragment," when referring to a nucleic acid, means a nucleic acid that is shorter or has fewer nucleotides than the full-length nucleic acid. A fragment can be, for example, when referring to a protein fragment, an N-terminal fragment (i.e., removal of a portion of the C-terminal end of the protein), a C-terminal fragment (i.e., removal of a portion of the N-terminal end of the protein), or an internal fragment (i.e., removal of a portion of an internal portion of the protein).

"Sequence identity" or "identity" in the context of two polynucleotides or polypeptide sequences refers to the residues in the two sequences that are the same when aligned for maximum correspondence over a specified comparison window. When percentage of sequence identity is used in reference to proteins, residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity." Means for making this adjustment are well known. Typically, this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, California).

"Percentage of sequence identity" includes the value determined by comparing two optimally aligned sequences (greatest number of perfectly matched residues) over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity. Unless otherwise specified (e.g., the shorter sequence includes a linked heterologous sequence), the comparison window is the full length of the shorter of the two sequences being compared.

Unless otherwise stated, sequence identity/similarity values include the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. "Equivalent program" includes any sequence comparison program that, for any two sequences in question, generates an alignment having identical nucleotide or amino acid residue matches and an identical percent sequence identity when compared to the corresponding alignment generated by GAP Version 10.

The term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine, or leucine for another non-polar residue. Likewise, examples of conservative substitutions include the substitution of one polar (hydrophilic) residue for another such as between arginine and lysine, between glutamine and asparagine, or between glycine and serine. Additionally, the substitution of a basic residue such as lysine, arginine, or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, or methionine for a polar (hydrophilic) residue such as cysteine, glutamine, glutamic acid or lysine and/or a polar residue for a non-polar residue. Typical amino acid categorizations are summarized in Table 1 below.

TABLE 1

Amino Acid Categorizations.

| Alanine | Ala | A | Nonpolar | Neutral | 1.8 |
|---|---|---|---|---|---|
| Arginine | Arg | R | Polar | Positive | −4.5 |
| Asparagine | Asn | N | Polar | Neutral | −3.5 |
| Aspartic acid | Asp | D | Polar | Negative | −3.5 |
| Cysteine | Cys | C | Nonpolar | Neutral | 2.5 |
| Glutamic acid | Glu | E | Polar | Negative | −3.5 |
| Glutamine | Gln | Q | Polar | Neutral | −3.5 |
| Glycine | Gly | G | Nonpolar | Neutral | −0.4 |
| Histidine | His | H | Polar | Positive | −3.2 |
| Isoleucine | Ile | I | Nonpolar | Neutral | 4.5 |
| Leucine | Leu | L | Nonpolar | Neutral | 3.8 |
| Lysine | Lys | K | Polar | Positive | −3.9 |
| Methionine | Met | M | Nonpolar | Neutral | 1.9 |
| Phenylalanine | Phe | F | Nonpolar | Neutral | 2.8 |
| Proline | Pro | P | Nonpolar | Neutral | −1.6 |
| Serine | Ser | S | Polar | Neutral | −0.8 |
| Threonine | Thr | T | Polar | Neutral | −0.7 |
| Tryptophan | Trp | W | Nonpolar | Neutral | −0.9 |
| Tyrosine | Tyr | Y | Polar | Neutral | −1.3 |
| Valine | Val | V | Nonpolar | Neutral | 4.2 |

A "homologous" sequence (e.g., nucleic acid sequence) includes a sequence that is either identical or substantially similar to a known reference sequence, such that it is, for example, at least 50%, at least 55%, at least 60%, at least 65%, at least 70%, at least 75%, at least 80%, at least 85%, at least 90%, at least 95%, at least 96%, at least 97%, at least 98%, at least 99%, or 100% identical to the known reference sequence. Homologous sequences can include, for example, orthologous sequence and paralogous sequences. Homologous genes, for example, typically descend from a common ancestral DNA sequence, either through a speciation event (orthologous genes) or a genetic duplication event (paralogous genes). "Orthologous" genes include genes in different species that evolved from a common ancestral gene by speciation. Orthologs typically retain the same function in the course of evolution. "Paralogous" genes include genes related by duplication within a genome. Paralogs can evolve new functions in the course of evolution.

The term "in vitro" includes artificial environments and to processes or reactions that occur within an artificial environment (e.g., a test tube or an isolated cell or cell line). The term "in vivo" includes natural environments (e.g., a cell or organism or body) and to processes or reactions that occur within a natural environment. The term "ex vivo" includes cells that have been removed from the body of an individual and processes or reactions that occur within such cells.

Repair in response to double-strand breaks (DSBs) occurs principally through two conserved DNA repair pathways: homologous recombination (HR) and non-homologous end joining (NHEJ). See Kasparek & Humphrey (2011) *Seminars in Cell & Dev. Biol.* 22:886-897, herein incorporated by reference in its entirety for all purposes. Likewise, repair of a target nucleic acid mediated by an exogenous donor nucleic acid can include any process of exchange of genetic information between the two polynucleotides.

The term "recombination" includes any process of exchange of genetic information between two polynucleotides and can occur by any mechanism. Recombination can occur via homology directed repair (HDR) or homologous recombination (HR). HDR or HR includes a form of nucleic acid repair that can require nucleotide sequence homology, uses a "donor" molecule as a template for repair of a "target" molecule (i.e., the one that experienced the double-strand break), and leads to transfer of genetic information from the donor to target. Without wishing to be bound by any particular theory, such transfer can involve mismatch correction of heteroduplex DNA that forms between the broken target and the donor, and/or synthesis-dependent strand annealing, in which the donor is used to resynthesize genetic information that will become part of the target, and/or related processes. In some cases, the donor polynucleotide, a portion of the donor polynucleotide, a copy of the donor polynucleotide, or a portion of a copy of the donor polynucleotide integrates into the target DNA. See Wang et al. (2013) *Cell* 153:910-918; Mandalos et al. (2012) *PLOS ONE* 7:e45768:1-9; and Wang et al. (2013) *Nat Biotechnol.* 31:530-532, each of which is herein incorporated by reference in its entirety for all purposes.

Non-homologous end joining (NHEJ) includes the repair of double-strand breaks in a nucleic acid by direct ligation of the break ends to one another or to an exogenous sequence without the need for a homologous template. Ligation of non-contiguous sequences by NHEJ can often result in deletions, insertions, or translocations near the site of the double-strand break. For example, NHEJ can also result in the targeted integration of an exogenous donor nucleic acid through direct ligation of the break ends with the ends of the exogenous donor nucleic acid (i.e., NHEJ-based capture). Such NHEJ-mediated targeted integration can be preferred for insertion of an exogenous donor nucleic acid when homology directed repair (HDR) pathways are not readily usable (e.g., in non-dividing cells, primary cells, and cells which perform homology-based DNA repair poorly). In addition, in contrast to homology-directed repair, knowledge concerning large regions of sequence identity flanking the cleavage site is not needed, which can be beneficial when attempting targeted insertion into organisms that have genomes for which there is limited knowledge of the genomic sequence. The integration can proceed via ligation of blunt ends between the exogenous donor nucleic acid and the cleaved genomic sequence, or via ligation of sticky ends (i.e., having 5' or 3' overhangs) using an exogenous donor nucleic acid that is flanked by overhangs that are compatible with those generated by a nuclease agent in the cleaved genomic sequence. See, e.g., US 2011/020722, WO 2014/033644, WO 2014/089290, and Maresca et al. (2013) *Genome Res.* 23(3):539-546, each of which is herein incorporated by reference in its entirety for all purposes. If blunt ends are ligated, target and/or donor resection may be needed to generation regions of microhomology needed for fragment joining, which may create unwanted alterations in the target sequence.

Compositions or methods "comprising" or "including" one or more recited elements may include other elements not specifically recited. For example, a composition that "comprises" or "includes" a protein may contain the protein alone or in combination with other ingredients. The transitional phrase "consisting essentially of" means that the scope of a claim is to be interpreted to encompass the specified elements recited in the claim and those that do not materially affect the basic and novel characteristic(s) of the claimed invention. Thus, the term "consisting essentially of" when used in a claim of this invention is not intended to be interpreted to be equivalent to "comprising."

"Optional" or "optionally" means that the subsequently described event or circumstance may or may not occur and that the description includes instances in which the event or circumstance occurs and instances in which the event or circumstance does not.

Designation of a range of values includes all integers within or defining the range, and all subranges defined by integers within the range.

Unless otherwise apparent from the context, the term "about" encompasses values ±5 of a stated value.

The term "and/or" refers to and encompasses any and all possible combinations of one or more of the associated listed items, as well as the lack of combinations when interpreted in the alternative ("or").

The term "or" refers to any one member of a particular list and also includes any combination of members of that list.

The singular forms of the articles "a," "an," and "the" include plural references unless the context clearly dictates otherwise. For example, the term "a protein" or "at least one protein" can include a plurality of proteins, including mixtures thereof.

Statistically significant means $p \leq 0.05$.

DETAILED DESCRIPTION

I. Overview

X-linked juvenile retinoschisis (XLRS) is juvenile-onset macular degeneration caused by mutations in retinoschisin (RS1). The RS1 gene encodes a 24 kDa discoidin-domain-containing protein that is secreted as a homo-oligomeric complex. Gene mutations of RS1 lead to either a non-functional protein or the absence of protein secretion, which causes schisis or splitting within the retinal layers leading to early and progressive vision loss. More than 200 different mutations in the RS1 gene are known to cause XLRS. Forty percent of the disease-causing mutations are nonsense or frameshift mutations that are predicted to result in the absence of a full-length retinoschisin protein. Fifty percent of the disease-causing mutations are missense mutations that allow for production of full-length mutant protein. Most of these are in the discoidin domain and result in misfolded protein retained in ER.

Because XLRS is a recessive disease caused by the loss in retinoschisin function, gene replacement therapy is as a potential treatment for this disease. Furthermore, because retinoschisin functions as an extracellular protein, beneficial treatment is not necessarily restricted to the transfected cell expressing the replacement gene but can encompass a wider area due to the spread of the secreted protein from the site of expression.

Provided herein are nucleic acid constructs and compositions that allow insertion of a retinoschisin coding sequence into a target genomic locus such as an endogenous RS1 locus and/or expression of the retinoschisin coding sequence. The nucleic acid constructs and compositions can be used in methods for integration into a target genomic locus and/or expression in a cell or in methods of treating X-linked juvenile retinoschisis. Also provided are nuclease agents (e.g., targeting an endogenous RS1 locus) or nucleic acids encoding nuclease agents to facilitate integration of the nucleic acid constructs into a target genomic locus such as an endogenous RS1 locus.

Integration of the nucleic acid construct into an endogenous RS1 locus, such as intron 1 of RS1, can prevent transcription of the endogenous RS1 gene downstream of the integration site. The integration of the nucleic acid construct into the endogenous RS1 locus can reduce or eliminate expression of the endogenous retinoschisin protein (e.g., an endogenous retinoschisin protein with an XLRS-causing mutation) and replace it with expression of the retinoschisin protein or fragment or variant thereof encoded by the nucleic acid construct (e.g., retinoschisin without an XLRS-causing mutation). In one example, integration of the nucleic acid construct into the endogenous RS1 locus reduces expression of the endogenous retinoschisin protein. In another example, integration of the nucleic acid construct into the endogenous RS1 locus eliminates expression of the endogenous retinoschisin protein. In this way, integration of the nucleic acid construct can simultaneously knock out the endogenous RS1 gene (e.g., an endogenous RS1 gene comprising one or more mutations associated with or that cause XLRS, such as R141C) and knock in a replacement retinoschisin coding sequence (e.g., a replacement retinoschisin coding sequence that does not comprise mutations associated with or that cause XLRS).

II. Nucleic Acid Constructs Comprising a Retinoschisin Coding Sequence for Integration into and Expression from a Target Genomic Locus Provided herein are nucleic acid constructs (i.e., exogenous donor nucleic acids) comprising a retinoschisin coding sequence (i.e., encoding a retinoschisin protein or fragment or variant thereof) for integration into and expression from a target genomic locus. The nucleic acid constructs can be isolated nucleic acid constructs.

Retinoschisin (X-linked juvenile retinoschisis protein) is a protein required for normal structure and function of the retina. An exemplary human retinoschisin protein is assigned UniProt Accession No. O15537 and has the sequence set forth in SEQ ID NO: 2. Orthologs in other species are also known. For example, an exemplary mouse retinoschisin protein is assigned UniProt Accession No. Q9Z1L4 and has the sequence set forth in SEQ ID NO: 1. Retinoschisin is encoded by the RS1 gene (also known as XLRS1). The human RS1 gene contains six separate exons interspaced by five introns. The human RS1 gene is assigned NCBI GeneID 6247. The mouse Rs1 gene is assigned NCBI GeneID 20147. An exemplary coding sequence for human RS1 is assigned CCDS ID CCDS14187.1 and is set forth in SEQ ID NO: 6. Mutations in retinoschisin cause X-linked juvenile retinoschisis (XLRS), a vitreo-retinal dystrophy characterized by macular pathology and by splitting of the superficial layer of the retina. The nucleic acid constructs disclosed herein can be used in methods to treat XLRS as described in more detail elsewhere herein.

The functional domains of RS1 are a signal peptide (SP), RS1, and the discoidin domains. The signal sequence guides the translocation of nascent RS1 from the endoplasmic reticulum (the site of synthesis) to external leaflet of the plasma membrane, during which signal sequence is cleaved by signal peptidase to generate mature protein with characteristic RS1 and a highly conserved discoidin domain. The different subdomains of RS1 signal sequence are the positively charged N region at the amino terminal end which mediates translocation, the hydrophobic core (H) required for targeting and membrane insertion and a polar "C" region that determines the site of recognition and cleavage by signal peptidase. RS1 is prominently expressed by the retinal photoreceptor and bipolar cells and is also in the pineal gland.

The retinoschisin coding sequence included in the nucleic acid constructs disclosed herein can be a coding sequence for a full-length retinoschisin protein or a fragment or variant thereof. In one example, the retinoschisin coding sequence included in the nucleic acid construct does not include the first exon of RS1. For example, the retinoschisin coding sequence included in the nucleic acid construct can include exons 2-6 of an RS1 gene or variants or degenerate variants thereof. As one example, a cDNA fragment comprising exons 2-6 of an RS1 gene can comprise the sequence set forth in SEQ ID NO: 8. Although each of the 64 codons is specific for only one amino acid or stop signal, the genetic code is degenerate (i.e., redundant) because a single amino acid may be coded for by more than one codon. A degenerate variant of a gene encodes the same protein but uses at least one different codon. The retinoschisin coding sequence in the nucleic acid construct can comprise complementary DNA (cDNA) without intervening introns, or the nucleic acid construct can comprise one or more introns separating exons in the retinoschisin coding sequence. For example, the nucleic acid construct can comprise a sequence corresponding to the RS1 genomic locus having both exons and introns.

The retinoschisin coding sequence can be from any organism. For example, the retinoschisin coding sequence can be mammalian, non-human mammalian, rodent, mouse, rat, or human or variants thereof. Alternatively, the retinoschisin coding sequence can be chimeric (e.g., part mouse and part human). In a specific example, the retinoschisin coding sequence is a human retinoschisin coding sequence.

The retinoschisin coding sequence can be codon-optimized for efficient translation into retinoschisin in a particular cell or organism. As one example, a codon-optimized version of exons 2-6 of human RS1 is set forth in SEQ ID NO: 9. For example, the nucleic acid can be modified to substitute codons having a higher frequency of usage in a human cell, a non-human cell, a mammalian cell, a rodent cell, a mouse cell, a rat cell, or any other host cell of interest.

The retinoschisin coding sequence can encode a wild type retinoschisin protein or a fragment or variant thereof. Likewise, the retinoschisin coding sequence can be a wild type coding sequence or variant thereof. In one example, the retinoschisin coding sequence does not comprise any mutations associated with or that cause X-linked juvenile retinoschisis. Alternatively, the retinoschisin coding sequence can comprise one or more mutations associated with or that cause X-linked juvenile retinoschisis (e.g., R141C).

The nucleic acid construct can further comprise one or more RS1 introns or fragments or variants thereof (e.g., one or more human RS1 introns or fragments or variants thereof). For example, the nucleic acid construct can comprise RS1 intron 1 or a fragment or variant thereof. The RS1 intron or the fragment or variant thereof can comprise a splice acceptor site or a fragment thereof. Examples of fragments of RS1 intron 1 are set forth in SEQ ID NOS: 15 and 16. In one specific example, the nucleic acid construct can comprise RS1 intron 1 or a fragment or variant thereof located 5' of exons 2-6 of RS1 (e.g., upstream of a cDNA sequence comprising, consisting essentially of, or consisting of exons 2-6 of RS1).

The nucleic acid constructs can further comprise one or more splice acceptor sites. Examples of sequences (e.g., intronic sequences) and reverse complements thereof comprising splice acceptor sites are set forth in SEQ ID NOS: 15-21. For example, the nucleic acid construct can comprise a splice acceptor site located 5' of the retinoschisin coding sequence. In a specific example, the retinoschisin coding sequence comprises, consists essentially of, or consists of exons 2-6 of RS1 (e.g., exons 2-6 of human RS1), and the splice acceptor site is the splice acceptor site from intron 1 of RS1 (e.g., human RS1) used in splicing RS1 exon 1 to RS1 exon 2. The term splice acceptor site refers to a nucleic acid sequence at a 3' intron/exon boundary that can be recognized and bound by splicing machinery.

The nucleic acid constructs disclosed herein can also comprise post-transcriptional regulatory elements, such as the woodchuck hepatitis virus post-transcriptional regulatory element.

The nucleic acid constructs can further comprise one or more polyadenylation signal sequences. Examples of polyadenylation signal sequences, or sequences comprising polyadenylation signal sequences, or reverse complements thereof are set forth in SEQ ID NOS: 22-25. For example, the nucleic acid construct can comprise a polyadenylation signal sequence located 3' of the retinoschisin coding sequence. Any suitable polyadenylation signal sequence can be used. The term polyadenylation signal sequence refers to any sequence that directs termination of transcription and addition of a poly-A tail to the mRNA transcript. In eukaryotes, transcription terminators are recognized by protein factors, and termination is followed by polyadenylation, a process of adding a poly(A) tail to the mRNA transcripts in presence of the poly(A) polymerase. The mammalian poly (A) signal typically consists of a core sequence, about 45 nucleotides long, that may be flanked by diverse auxiliary sequences that serve to enhance cleavage and polyadenylation efficiency. The core sequence consists of a highly conserved upstream element (AATAAA or AAUAAA) in the mRNA, referred to as a poly A recognition motif or poly A recognition sequence), recognized by cleavage and polyadenylation-specificity factor (CPSF), and a poorly defined downstream region (rich in Us or Gs and Us), bound by cleavage stimulation factor (CstF). Examples of transcription terminators that can be used include, for example, the human growth hormone (HGH) polyadenylation signal, the simian virus 40 (SV40) late polyadenylation signal, the rabbit beta-globin polyadenylation signal, the bovine growth hormone (BGH) polyadenylation signal, the phosphoglycerate kinase (PGK) polyadenylation signal, an AOX1 transcription termination sequence, a CYC1 transcription termination sequence, or any transcription termination sequence known to be suitable for regulating gene expression in eukaryotic cells.

The nucleic acid constructs can also comprise a polyadenylation signal sequence upstream of the retinoschisin coding sequence. The polyadenylation signal sequence upstream of the retinoschisin coding sequence can be flanked by recombinase recognition sites recognized by a site-specific recombinase. In some constructs, the recombinase recognition sites also flank a selection cassette comprising, for example, the coding sequence for a drug resistance protein. In other constructs, the recombinase recognition sites do not flank a selection cassette. The polyadenylation signal sequence prevents transcription and expression of the protein or RNA encoded by the coding sequence. However, upon exposure to the site-specific recombinase, the polyadenylation signal sequence will be excised, and the protein or RNA can be expressed.

Such a configuration can enable tissue-specific expression or developmental-stage-specific expression in animals comprising the retinoschisin coding sequence if the polyadenylation signal sequence is excised in a tissue-specific or developmental-stage-specific manner. Excision of the polyadenylation signal sequence in a tissue-specific or developmental-stage-specific manner can be achieved if an animal comprising the nucleic acid construct further comprises a coding sequence for the site-specific recombinase operably linked to a tissue-specific or developmental-stage-specific promoter. The polyadenylation signal sequence will then be excised only in those tissues or at those developmental stages, enabling tissue-specific expression or developmental-stage-specific expression. In one example, the retinoschisin or fragment or variant thereof encoded by the nucleic acid constructs can be expressed in an eye-specific or retinal-cell-specific manner.

Site-specific recombinases include enzymes that can facilitate recombination between recombinase recognition sites, where the two recombination sites are physically separated within a single nucleic acid or on separate nucleic acids. Examples of recombinases include Cre, Flp, and Dre recombinases. One example of a Cre recombinase gene is Crei, in which two exons encoding the Cre recombinase are separated by an intron to prevent its expression in a prokaryotic cell. Such recombinases can further comprise a nuclear localization signal to facilitate localization to the nucleus (e.g., NLS-Crei). Recombinase recognition sites include nucleotide sequences that are recognized by a site-specific recombinase and can serve as a substrate for a recombination event. Examples of recombinase recognition sites include FRT, FRT11, FRT71, attp, att, rox, and lox sites such as loxP, lox511, lox2272, lox66, lox71, loxM2, and lox5171.

The nucleic acid constructs can further comprise a promoter operably linked to the retinoschisin coding sequence. The retinoschisin coding sequence in the nucleic acid construct can be operably linked to any suitable promoter for expression in vivo within an animal or in vitro within an isolated cell. The promoter can be a constitutively active promoter (e.g., a CAG promoter or a U6 promoter), a conditional promoter, an inducible promoter, a temporally restricted promoter (e.g., a developmentally regulated promoter), or a spatially restricted promoter (e.g., a cell-specific or tissue-specific promoter). Such promoters are well-known and are discussed elsewhere herein. Promoters that can be used in an expression construct include promoters active, for example, in one or more of a eukaryotic cell, a human cell, a non-human cell, a mammalian cell, a non-human mammalian cell, a rodent cell, a mouse cell, a rat cell, a hamster cell, a rabbit cell, a pluripotent cell, an eye cell, a retinal cell, an embryonic stem (ES) cell, or a zygote. In a specific example, the promoter is active in an eye cell or a retinal cell.

Alternatively, some nucleic acid constructs do not comprise a promoter operably linked to the retinoschisin coding sequence (e.g., some nucleic acid constructs are promoterless constructs). Such nucleic acid constructs can be designed, for example, to be operably linked to an endogenous promoter at a target genomic locus (e.g., an endogenous RS1 promoter at an endogenous RS1 locus) upon integration into the target genomic locus.

Any target genomic locus capable of expressing a gene can be used, such as a safe harbor locus (safe harbor gene) or an endogenous RS1 locus. Interactions between integrated exogenous DNA and a host genome can limit the reliability and safety of integration and can lead to overt phenotypic effects that are not due to the targeted genetic modification but are instead due to unintended effects of the integration on surrounding endogenous genes. For example, randomly inserted transgenes can be subject to position effects and silencing, making their expression unreliable and unpredictable. Likewise, integration of exogenous DNA into a chromosomal locus can affect surrounding endogenous genes and chromatin, thereby altering cell behavior and phenotypes. Safe harbor loci include chromosomal loci where transgenes or other exogenous nucleic acid inserts can be stably and reliably expressed in all tissues of interest without overtly altering cell behavior or phenotype (i.e., without any deleterious effects on the host cell). See, e.g., Sadelain et al. (2012) *Nat. Rev. Cancer* 12:51-58, herein incorporated by reference in its entirety for all purposes. For example, the safe harbor locus can be one in which expression of the inserted gene sequence is not perturbed by any read-through expression from neighboring genes. For example, safe harbor loci can include chromosomal loci where exogenous DNA can integrate and function in a predictable manner without adversely affecting endogenous gene structure or expression. Safe harbor loci can include extragenic regions or intragenic regions such as, for example, loci within genes that are non-essential, dispensable, or able to be disrupted without overt phenotypic consequences.

Such safe harbor loci can offer an open chromatin configuration in all tissues and can be ubiquitously expressed during embryonic development and in adults. See, e.g., Zambrowicz et al. (1997) *Proc. Natl. Acad. Sci. U.S.A.* 94:3789-3794, herein incorporated by reference in its entirety for all purposes. In addition, the safe harbor loci can be targeted with high efficiency, and safe harbor loci can be disrupted with no overt phenotype. Examples of safe harbor loci include albumin, CCR5, HPRT, AAVS1, and Rosa26. See, e.g., U.S. Pat. Nos. 7,888,121; 7,972,854; 7,914,796; 7,951,925; 8,110,379; 8,409,861; 8,586,526; and US Patent Publication Nos. 2003/0232410; 2005/0208489; 2005/0026157; 2006/0063231; 2008/0159996; 2010/00218264; 2012/0017290; 2011/0265198; 2013/0137104; 2013/0122591; 2013/0177983; 2013/0177960; and 2013/0122591, each of which is herein incorporated by reference in its entirety for all purposes.

The target genomic locus can also be an endogenous RS1 locus, such as an endogenous RS1 locus comprising one or more mutations associated with or that cause XLRS (e.g., an R141C mutation in the encoded retinoschisin protein). Integration of the nucleic acid construct into the endogenous RS1 locus can, in some cases, prevent transcription of the endogenous RS1 gene downstream of the integration site. The integration of the nucleic acid construct into the endogenous RS1 locus can reduce or eliminate expression of the endogenous retinoschisin protein and replace it with expression of the retinoschisin protein or fragment or variant thereof encoded by the nucleic acid construct. In one example, integration of the nucleic acid construct into the endogenous RS1 locus reduces expression of the endogenous retinoschisin protein. In another example, integration of the nucleic acid construct into the endogenous RS1 locus eliminates expression of the endogenous retinoschisin protein. In this way, integration of the nucleic acid construct can simultaneously knock out the endogenous RS1 gene (e.g., an endogenous RS1 gene comprising one or more mutations associated with or that cause XLRS) and knock in a replacement retinoschisin coding sequence (e.g., a replacement retinoschisin coding sequence that does not comprise mutations associated with or that cause XLRS).

The nucleic acid construct can be integrated into any part of the target genomic locus. For example, the nucleic acid construct can be inserted into an intron or an exon of a target genomic locus or can replace one or more introns and/or exons of a target genomic locus. In a specific example, the nucleic acid construct can be integrated into an intron of the target genomic locus, such as the first intron of the target genomic locus (e.g., RS1 intron 1). Expression cassettes integrated into a target genomic locus can be operably linked to an endogenous promoter at the target genomic locus (e.g., the endogenous RS1 promoter) or can be operably linked to an exogenous promoter that is heterologous to the target genomic locus (e.g., a CMV promoter).

The nucleic acid constructs can comprise deoxyribonucleic acid (DNA) or ribonucleic acid (RNA), they can be single-stranded or double-stranded, and they can be in linear or circular form. For example, the nucleic acid construct can be a single-stranded oligodeoxynucleotide (ssODN). See, e.g., Yoshimi et al. (2016) *Nat. Commun.* 7:10431, herein incorporated by reference in its entirety for all purposes. The nucleic acid constructs can be naked nucleic acids or can be delivered by vectors, such as AAV vectors. In a specific example, the nucleic acid construct can be delivered via AAV and can be capable of insertion into an endogenous RS1 locus by non-homologous end joining (e.g., the nucleic acid construct can be one that does not comprise homology arms). If introduced in linear form, the ends of the nucleic acid construct (e.g., donor sequence) can be protected (e.g., from exonucleolytic degradation) by well-known methods. For example, one or more dideoxynucleotide residues can be added to the 3' terminus of a linear molecule and/or self-complementary oligonucleotides can be ligated to one or both ends. See, e.g., Chang et al. (1987) *Proc. Natl. Acad. Sci. U.S.A.* 84:4959-4963 and Nehls et al. (1996) *Science* 272:886-889, each of which is herein incorporated by reference in its entirety for all purposes. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues.

An exemplary nucleic acid construct is between about 50 nucleotides to about 5 kb in length or between about 50 nucleotides to about 3 kb in length. Alternatively, a nucleic acid construct can be between about 1 kb to about 1.5 kb, about 1.5 kb to about 2 kb, about 2 kb to about 2.5 kb, about 2.5 kb to about 3 kb, about 3 kb to about 3.5 kb, about 3.5 kb to about 4 kb, about 4 kb to about 4.5 kb, or about 4.5 kb to about 5 kb in length. Alternatively, a nucleic acid construct can be, for example, no more than 5 kb, 4.5 kb, 4 kb, 3.5 kb, 3 kb, or 2.5 kb in length.

Integration of a nucleic acid construct at a target genomic locus can result in addition of a nucleic acid sequence of interest to the target genomic locus or replacement of a nucleic acid sequence of interest at the target genomic locus (i.e., deletion and insertion). Some nucleic acid constructs are designed for insertion of a nucleic acid construct at a target genomic locus without any corresponding deletion at the target genomic locus. Other nucleic acid constructs are designed to delete a nucleic acid sequence of interest at a target genomic locus and replace it with a nucleic acid construct.

The nucleic acid construct or the corresponding nucleic acid at the target genomic locus being deleted and/or replaced can be various lengths. An exemplary nucleic acid construct or corresponding nucleic acid at the target genomic locus being deleted and/or replaced is between about 1 nucleotide to about 5 kb in length or is between about 1 nucleotide to about 3 kb nucleotides in length. For example, a nucleic acid construct or a corresponding nucleic acid at the target genomic locus being deleted and/or replaced can be between about 1 to about 100, about 100 to about 200, about 200 to about 300, about 300 to about 400, about 400 to about 500, about 500 to about 600, about 600 to about 700, about 700 to about 800, about 800 to about 900, or about 900 to about 1,000 nucleotides in length. Likewise, a nucleic acid construct or a corresponding nucleic acid at the target genomic locus being deleted and/or replaced can be between about 1 kb to about 1.5 kb, about 1.5 kb to about 2 kb, about 2 kb to about 2.5 kb, about 2.5 kb to about 3 kb, about 3 kb to about 3.5 kb, about 3.5 kb to about 4 kb, about 4 kb to about 4.5 kb, about 4.5 kb to about 5 kb in length, or longer.

The nucleic acid construct or the corresponding nucleic acid at the target genomic locus being deleted and/or replaced can be a coding region such as an exon; a non-coding region such as an intron, an untranslated region, or a regulatory region (e.g., a promoter, an enhancer, or a transcriptional repressor-binding element), or any combination thereof.

The nucleic acid constructs can, in some cases, comprise one or more of the following terminal structures: hairpin, loop, inverted terminal repeat (ITR), or toroid. For example, the nucleic acid construct can comprise ITRs.

Some such nucleic acid constructs can modify the target genomic locus (e.g., but not limited to, an endogenous RS1 locus) following cleavage or nicking of the target genomic locus with a nuclease agent such as a Cas protein. The nucleic acid construct can be designed to repair the cleaved or nicked locus via non-homologous end joining (NHEJ)-mediated ligation or homology-directed repair. Optionally, repair with the nucleic acid construct removes or disrupts the nuclease target sequence so that alleles that have been targeted cannot be re-targeted by the nuclease agent.

Some nucleic acid constructs comprise homology arms. The homology arms can be symmetrical (e.g., each 40 nucleotides or each 60 nucleotides in length), or they can be asymmetrical (e.g., one homology arm or complementary region that is 36 nucleotides in length, and one homology arm or complementary region that is 91 nucleotides in length). Other nucleic acid constructs do not comprise homology arms.

Some nucleic acid constructs disclosed herein comprise homology arms. The homology arms can flank the retinoschisin coding sequence. For ease of reference, the homology arms are referred to herein as 5' and 3' (i.e., upstream and downstream) homology arms. This terminology relates to the relative position of the homology arms to a nucleic acid insert (e.g., the retinoschisin coding sequence) within a nucleic acid construct. The 5' and 3' homology arms correspond to regions within the target genomic locus, which are referred to herein as "5' target sequence" and "3' target sequence," respectively.

A homology arm and a target sequence "correspond" or are "corresponding" to one another when the two regions share a sufficient level of sequence identity to one another to act as substrates for a homologous recombination reaction. The term "homology" includes DNA sequences that are either identical or share sequence identity to a corresponding sequence. The sequence identity between a given target sequence and the corresponding homology arm found in the nucleic acid construct can be any degree of sequence identity that allows for homologous recombination to occur. For example, the amount of sequence identity shared by the homology arm of the nucleic acid construct (or a fragment thereof) and the target sequence (or a fragment thereof) can be at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity, such that the sequences undergo homologous recombination. Moreover, a corresponding region of homology between the homology arm and the corresponding target sequence can be of any length that is sufficient to promote homologous recombination. Exemplary homology arms are between about 25 nucleotides to about 2.5 kb in length, are between about 25 nucleotides to about 1.5 kb in length, or are between about 25 to about 500 nucleotides in length. For example, a given homology arm (or each of the homology arms) and/or corresponding target sequence can comprise corresponding regions of homology that are between about 25 to about 30, about 30 to about 40, about 40 to about 50, about 50 to about 60, about 60 to about 70, about 70 to about 80, about 80 to about 90, about 90 to about 100, about 100 to about 150, about 150 to about 200, about 200 to about 250, about 250 to about 300, about 300 to about 350, about 350 to about 400, about 400 to about 450, or about 450 to about 500 nucleotides in length, such that the homology arms have sufficient homology to undergo homologous recombination with the corresponding target sequences within the target nucleic acid. Alternatively, a given homology arm (or each homology arm) and/or corresponding target sequence can comprise corresponding regions of homology that are between about 0.5 kb to about 1 kb, about 1 kb to about 1.5 kb, about 1.5 kb to about 2 kb, or about 2 kb to about 2.5 kb in length. For example, the homology arms can each be about 750 nucleotides in length. In another example, the homology arms can each be about 150 to about 750, about 200 to about 700, about 250 to about 650, about 300 to about 600, about 350 to about 550, about 400 to about 500, about 150 to about 450, about 200 to about 450, about 250 to about 450, about 300 to about 450, about 350 to about 450, about 400 to about 450, about 450 to about 500, about 450 to about 550, about 450 to about 600, about 450 to about 650, about 450 to about 700, about 450 to about 750, or about 450 nucleotides in length. In another example, the homology arms can each be about 500 to about 1300, about 550 to about 1250, about 600 to about 1200, about 650 to about 1150, about 700 to about 1100, about 750 to about 1050, about 800 to about 1000, about 850 to about 950, about 500 to about 900, about 550 to about 900, about 600 to about 900, about 650 to about 900, about 700 to about 900, about 750 to about 900, about 800 to about 900, about 850 to about 900, about 900 to about 950, about 900 to about 1000, about 900 to about 1050, about 900 to about 1100, about 900 to about 1150, about 900 to about 1200, about 900 to about 1250, about 900 to about 1300, or about 900 nucleotides in length. In another example, the homology arms can each be about 1500 to about 2100, about 1550 to about 2050, about 1600 to about 2000, about 1650 to about 1950, about 1700 to about 1900, about 1750 to about 1850, about 1500 to about 1800, about 1550 to about 1800, about 1600 to about 1800, about 1650 to about 1800, about 1700 to about 1800, about 1750 to about 1800, about 1800 to about 1850, about 1800 to about 1900, about 1800 to about 1950, about 1800 to about 2000, about 1800 to about 2050, about 1800 to about 2100, or about 1800 nucleotides. In another example, each homology arm is no more than about 450 nucleotides, no more than about 900 nucleotides, or no more than about 1800 nucleotides. In another example, each homology arm is at least about 450 nucleotides, at least about 900 nucleotides, or at least about 1800 nucleotides. The homology arms can be symmetrical (each about the same size in length), or they can be asymmetrical (one longer than the other).

When a CRISPR/Cas system or other nuclease agent is used in combination with an nucleic acid construct disclosed herein, the 5' and 3' target sequences can be located in sufficient proximity to the nuclease cleavage site (e.g., within sufficient proximity to a guide RNA target sequence) so as to promote the occurrence of a homologous recombination event between the target sequences and the homology arms upon a single-strand break (nick) or double-strand break at the nuclease cleavage site or nuclease cleavage site. The term "nuclease cleavage site" includes a DNA sequence at which a nick or double-strand break is created by a nuclease agent (e.g., a Cas9 protein complexed with a guide RNA). The target sequences within the targeted locus that correspond to the 5' and 3' homology arms of the nucleic acid construct are "located in sufficient proximity" to a nuclease cleavage site if the distance is such as to promote the occurrence of a homologous recombination event between the 5' and 3' target sequences and the homology arms upon a single-strand break or double-strand break at the nuclease cleavage site. Thus, the target sequences corresponding to the 5' and/or 3' homology arms of the nucleic acid construct can be, for example, within at least 1 nucleotide of a given nuclease cleavage site or within at least 10 nucleotides to about 1,000 nucleotides of a given nuclease cleavage site. As an example, the nuclease cleavage site can be immediately adjacent to at least one or both of the target sequences.

The spatial relationship of the target sequences that correspond to the homology arms of the nucleic acid construct and the nuclease cleavage site can vary. For example, target sequences can be located 5' to the nuclease cleavage site, target sequences can be located 3' to the nuclease cleavage site, or the target sequences can flank the nuclease cleavage site.

Other nucleic acid constructs do not comprise any homology arms. Such nucleic acid constructs can be capable of insertion by non-homologous end joining. For example, such nucleic acid constructs can be inserted into a blunt end double-strand break following cleavage with a nuclease agent. In a specific example, the nucleic acid construct acid can be delivered via AAV and can be capable of insertion into a target genomic locus by non-homologous end joining (e.g., the nucleic acid construct can be one that does not comprise homology arms).

In a specific example, the nucleic acid construct can be inserted via homology-independent targeted integration. For example, the retinoschisin coding sequence in the nucleic acid construct can be flanked on each side by a target site for a nuclease agent (e.g., the same target site as in the target genomic locus, and the same nuclease agent being used to cleave the target site in the target genomic locus). The nuclease agent can then cleave the target sites flanking the retinoschisin coding sequence. In a specific example, the nucleic acid construct is delivered AAV-mediated delivery, and cleavage of the target sites flanking the retinoschisin coding sequence can remove the inverted terminal repeats (ITRs) of the AAV. In some methods, the target site in the target genomic locus (e.g., a gRNA target sequence including the flanking protospacer adjacent motif) is no longer present if the retinoschisin coding sequence is inserted into the target genomic locus in the correct orientation but it is reformed if the retinoschisin coding sequence is inserted into the target genomic locus in the opposite orientation. This can help ensure that the retinoschisin coding sequence is inserted in the correct orientation for expression.

In one exemplary nucleic acid construct for homology-independent targeted integration into a target genomic locus, the retinoschisin protein or fragment thereof is a human retinoschisin protein or fragment thereof, the coding sequence for the retinoschisin protein or fragment thereof comprises complementary DNA (cDNA) comprising exons 2-6 of human RS1 or degenerate variants thereof, the nucleic acid construct does not comprise a promoter that drives expression of the retinoschisin protein or fragment thereof, the nucleic acid construct comprises a polyadenylation signal sequence located 3' of the coding sequence, the nucleic acid construct comprises a splice acceptor site located 5' of the coding sequence, and the nuclease target sequence in the nucleic acid construct is identical to a nuclease target sequence for integration into the target genomic locus, wherein the nuclease target sequence in the target genomic locus is destroyed if the nucleic acid construct is inserted in the correct orientation but is reformed if the nucleic acid construct is inserted into the target genomic locus in the opposite orientation.

In one exemplary nucleic acid construct for homology-independent targeted integration into a target genomic locus, the retinoschisin protein or fragment thereof comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 2 or 5. In one exemplary nucleic acid construct for homology-independent targeted integration into a target genomic locus, the coding sequence for the retinoschisin protein or fragment thereof comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 6, 8, or 9 or degenerate variants thereof. In one exemplary nucleic acid construct for homology-independent targeted integration into a target genomic locus, the nucleic acid construct comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 45.

Other nucleic acid constructs can have short single-stranded regions at the 5' end and/or the 3' end that are complementary to one or more overhangs created by nuclease-agent-mediated cleavage at the target genomic locus. For example, some nucleic acid constructs have short single-stranded regions at the 5' end and/or the 3' end that are complementary to one or more overhangs created by nuclease-mediated cleavage at 5' and/or 3' target sequences at the target genomic locus. Some such nucleic acid constructs have a complementary region only at the 5' end or only at the 3' end. For example, some such nucleic acid constructs have a complementary region only at the 5' end complementary to an overhang created at a 5' target sequence at the target genomic locus or only at the 3' end complementary to an overhang created at a 3' target sequence at the target genomic locus. Other such nucleic acid constructs have complementary regions at both the 5' and 3' ends. For example, other such nucleic acid constructs have complementary regions at both the 5' and 3' ends (e.g., complementary to first and second overhangs, respectively) generated by nuclease-mediated cleavage at the target genomic locus. For example, if the nucleic acid construct is double-stranded, the single-stranded complementary regions can extend from the 5' end of the top strand of the nucleic acid construct and the 5' end of the bottom strand of the donor nucleic acid, creating 5' overhangs on each end. Alternatively, the single-stranded complementary region can extend from the 3' end of the top strand of the nucleic acid construct and from the 3' end of the bottom strand of the template, creating 3' overhangs.

The complementary regions can be of any length sufficient to promote ligation between the nucleic acid construct and the target nucleic acid. Exemplary complementary regions are between about 1 to about 5 nucleotides in length, between about 1 to about 25 nucleotides in length, or between about 5 to about 150 nucleotides in length. For example, a complementary region can be at least about 1, 2, 3, 4, 5, 6, 7, 8, 9, 10, 11, 12, 13, 14, 15, 16, 17, 18, 19, 20, 21, 22, 23, 24, or 25 nucleotides in length. Alternatively, the complementary region can be about 5 to about 10, about 10 to about 20, about 20 to about 30, about 30 to about 40, about 40 to about 50, about 50 to about 60, about 60 to about 70, about 70 to about 80, about 80 to about 90, about 90 to about 100, about 100 to about 110, about 110 to about 120, about 120 to about 130, about 130 to about 140, about 140 to about 150 nucleotides in length, or longer.

Such complementary regions can be complementary to overhangs created by two pairs of nickases. Two double-strand breaks with staggered ends can be created by using first and second nickases that cleave opposite strands of DNA to create a first double-strand break, and third and fourth nickases that cleave opposite strands of DNA to create a second double-strand break. For example, a Cas protein can be used to nick first, second, third, and fourth guide RNA target sequences corresponding with first, second, third, and fourth guide RNAs. The first and second guide RNA target sequences can be positioned to create a first cleavage site such that the nicks created by the first and second nickases on the first and second strands of DNA create a double-strand break (i.e., the first cleavage site comprises the nicks within the first and second guide RNA target sequences). Likewise, the third and fourth guide RNA target sequences can be positioned to create a second cleavage site such that the nicks created by the third and fourth nickases on the first and second strands of DNA create a double-strand break (i.e., the second cleavage site comprises the nicks within the third and fourth guide RNA target sequences). The nicks within the first and second guide RNA target sequences and/or the third and fourth guide RNA target sequences can be off-set nicks that create overhangs. The offset window can be, for example, at least about 5 bp, 10 bp, 20 bp, 30 bp, 40 bp, 50 bp, 60 bp, 70 bp, 80 bp, 90 bp, 100 bp or more. See Ran et al. (2013) *Cell* 154:1380-1389; Mali et al. (2013) *Nat. Biotechnol.* 31:833-838; and Shen et al. (2014) *Nat. Methods* 11:399-404, each of which is herein incorporated by reference in its entirety for all purposes. In such cases, a double-stranded nucleic acid construct can be designed with single-stranded complementary regions that are complementary to the overhangs created by the nicks within the first and second guide RNA target sequences and by the nicks within the third and fourth guide RNA target sequences. Such nucleic acid construct can then be inserted by non-homologous-end-joining-mediated ligation.

Some of the nucleic acid constructs disclosed herein are bidirectional constructs that can be inserted into and expressed from the target genomic locus in either orientation. Such nucleic acid constructs can comprise a first segment comprising a first coding sequence for a first retinoschisin protein or fragment or variant thereof and a second segment comprising a reverse complement of a second coding sequence for a second retinoschisin protein or fragment or variant thereof. The second segment can be, for example, located 3' of the first segment in the nucleic acid construct.

The first segment and the second segment can be linked directly together or can be linked by a linker such as a peptide linker. The peptide linker can be any suitable length. For example, the linker can be between about 5 to about 2000 nucleotides in length. As an example, the linker sequence can be about 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250, 300, 500, 1000, 1500, 2000, or more nucleotides in length.

In some bidirectional constructs, the first retinoschisin protein or fragment or variant thereof is identical to the second retinoschisin protein or fragment or variant thereof. In other bidirectional constructs, the first retinoschisin protein or fragment or variant thereof is different from the second retinoschisin protein or fragment or variant thereof.

In some bidirectional constructs, the codon usage in the first coding sequence is the same as the codon usage in the second coding sequence. In other bidirectional constructs, the second coding sequence adopts a different codon usage from the codon usage of the first coding sequence in order to reduce hairpin formation. Such a reverse complement forms base pairs with fewer than all nucleotides of the coding sequence in the first segment, but it can optionally encode the same polypeptide.

The second segment can have any percentage of complementarity to the first segment. For example, the second segment sequence can have at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 97%, or at least about 99% complementarity to the first segment. As another example, the second segment sequence can have less than about 30%, less than about 35%, less than about 40%, less than about 45%, less than about 50%, less than about 55%, less than about 60%, less than about 65%, less than about 70%, less than about 75%, less than about 80%, less than about 85%, less than about 90%, less than about 95%, less than about 97%, or less than about 99% complementarity to the first segment. The reverse complement of the second coding sequence can be, in some nucleic acid constructs, not substantially complementary (e.g., not more than 70% complementary) to the first coding sequence, not substantially complementary to a fragment of the first coding sequence, highly complementary (e.g., at least 90% complementary) to the first coding sequence, highly complementary to a fragment of the first coding sequence, about 50% to about 80% identical to the reverse complement of the first coding sequence, or about 60% to about 100% identical to the reverse complement of the first coding sequence.

The bidirectional constructs can, in some cases, comprise one or more (e.g., two) polyadenylation signal sequences. In some bidirectional constructs, the first segment can comprise a first polyadenylation signal sequence. In some bidirectional constructs, the first segment can comprise a second polyadenylation signal sequence. In some bidirectional constructs, the first segment can comprise a first polyadenylation signal sequence, and the second segment can comprise a second polyadenylation signal sequence (e.g., a reverse complement of a polyadenylation signal sequence). In some bidirectional constructs, the first segment can comprise a first polyadenylation signal sequence located 3' of the first coding sequence. In some bidirectional constructs, the second segment can comprise a reverse complement of a second polyadenylation signal sequence located 5' of the reverse complement of the second coding sequence. In some bidirectional constructs, the first segment can comprise a first polyadenylation signal sequence located 3' of the first coding sequence, and the second segment can comprise a reverse complement of a second polyadenylation signal sequence located 5' of the reverse complement of the second coding sequence. The first and second polyadenylation signal sequences can be the same or different. In one example, the first and second polyadenylation signals are different.

The bidirectional constructs can, in some cases, can comprise one or more (e.g., two) splice acceptor sites. In some bidirectional constructs, the first segment can comprise a first splice acceptor site. In some bidirectional constructs, the first segment can comprise a second splice acceptor site. In some bidirectional constructs, the first segment can comprise a first splice acceptor site, and the second segment can comprise a second splice acceptor site (e.g., a reverse complement of a splice acceptor site). In some bidirectional constructs, the first segment comprises a first splice acceptor site located 5' of the first coding sequence. In some bidirectional constructs, the second segment comprises a reverse complement of a second splice acceptor site located 3' of the reverse complement of the second coding sequence. In some bidirectional constructs, the first segment comprises a first splice acceptor site located 5' of the first coding sequence, and the second segment comprises a reverse complement of a second splice acceptor site located 3' of the reverse complement of the second coding sequence. The first and second splice acceptor sites can be the same or different. In one example, the first and second splice acceptor sites are different. The first and/or the second splice acceptor site can be from an RS1 gene (e.g., from intron 1 of an RS1 gene) such as a human RS1 gene.

Some bidirectional constructs can comprise a promoter that drives expression of the first retinoschisin protein or fragment or variant thereof and/or the reverse complement of a promoter that drives expression of the second retinoschisin protein or fragment or variant thereof. Alternatively, a bidirectional construct can be a construct that does not comprise a promoter that drives expression of the first retinoschisin protein or fragment or variant thereof or the second retinoschisin protein or fragment or variant thereof (i.e., a promoterless construct).

One or both of the coding sequences can be codon-optimized for expression in a host cell. In some bidirectional constructs, only one of the coding sequences is codon-optimized. In some bidirectional constructs, the first coding sequence is codon-optimized. In some bidirectional constructs, the second coding sequence is codon-optimized. In some bidirectional constructs, both coding sequences are codon-optimized.

In an exemplary bidirectional construct, the second segment is located 3' of the first segment, both the first retinoschisin protein or fragment thereof and the second retinoschisin protein or fragment thereof are a human retinoschisin protein or fragment thereof, the first retinoschisin protein or fragment thereof is identical to the second retinoschisin protein or fragment thereof, both the first coding sequence and the second coding sequence comprise complementary DNA (cDNA) comprising exons 2-6 of human RS1 or degenerate variants thereof, the second coding sequence adopts a different codon usage from the codon usage of the first coding sequence, the first segment comprises a first polyadenylation signal sequence located 3' of the first coding sequence, and the second segment comprises a reverse complement of a second polyadenylation signal sequence located 5' of the reverse complement of the second coding sequence, the first segment comprises a first splice acceptor site located 5' of the first coding sequence, and the second segment comprises a reverse complement of a second splice acceptor site located 3' of the reverse complement of the second coding sequence, the nucleic acid construct does not comprise a promoter that drives expression of the first retinoschisin protein or fragment thereof or the second retinoschisin protein or fragment thereof, and optionally the nucleic acid construct does not comprise a homology arm.

In an exemplary bidirectional construct, the first retinoschisin protein or fragment thereof and/or the second retinoschisin protein or fragment thereof comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 2 or 5. In an exemplary bidirectional construct, the first coding sequence and/or the second coding sequence comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 6, 8, or 9 or degenerate variants thereof. In an exemplary bidirectional construct, the first coding sequence comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 8, and the second coding sequence comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 9. In an exemplary bidirectional construct, the nucleic acid construct comprises, consists essentially of, or consists of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 46 or 47.

The nucleic acid constructs can include modifications or sequences that provide for additional desirable features (e.g., modified or regulated stability; tracking or detecting with a fluorescent label; a binding site for a protein or protein complex; and so forth). Nucleic acid constructs can comprise one or more fluorescent labels, purification tags, epitope tags, or a combination thereof. For example, a nucleic acid construct can comprise one or more fluorescent labels (e.g., fluorescent proteins or other fluorophores or dyes), such as at least 1, at least 2, at least 3, at least 4, or at least 5 fluorescent labels. Exemplary fluorescent labels include fluorophores such as fluorescein (e.g., 6-carboxyfluorescein (6-FAM)), Texas Red, HEX, Cy3, Cy5, Cy5.5, Pacific Blue, 5-(and-6)-carboxytetramethylrhodamine (TAMRA), and Cy7. A wide range of fluorescent dyes are available commercially for labeling oligonucleotides (e.g., from Integrated DNA Technologies). Such fluorescent labels (e.g., internal fluorescent labels) can be used, for example, to detect a nucleic acid construct that has been directly integrated into a cleaved target nucleic acid having protruding ends compatible with the ends of the nucleic acid construct. The label or tag can be at the 5' end, the 3' end, or internally within the nucleic acid construct. For example, a nucleic acid construct can be conjugated at 5' end with the IR700 fluorophore from Integrated DNA Technologies (5'IRDYE®700).

The nucleic acid construct can also comprise a conditional allele. The conditional allele can be a multifunctional allele, as described in US 2011/0104799, herein incorporated by reference in its entirety for all purposes. For example, the conditional allele can comprise: (a) an actuating sequence in sense orientation with respect to transcription of a target gene; (b) a drug selection cassette (DSC) in sense or antisense orientation; (c) a nucleotide sequence of interest (NSI) in antisense orientation; and (d) a conditional by inversion module (COIN, which utilizes an exon-splitting intron and an invertible gene-trap-like module) in reverse orientation. See, e.g., US 2011/0104799. The conditional allele can further comprise recombinable units that recombine upon exposure to a first recombinase to form a conditional allele that (i) lacks the actuating sequence and the DSC; and (ii) contains the NSI in sense orientation and the COIN in antisense orientation. See, e.g., US 2011/0104799.

Nucleic acid constructs can also comprise a polynucleotide encoding a selection marker. Alternatively, the nucleic acid constructs can lack a polynucleotide encoding a selection marker. The selection marker can be contained in a selection cassette. Optionally, the selection cassette can be a self-deleting cassette. See, e.g., U.S. Pat. No. 8,697,851 and US 2013/0312129, each of which is herein incorporated by reference in its entirety for all purposes. As an example, the self-deleting cassette can comprise a Crei gene (comprises two exons encoding a Cre recombinase, which are separated by an intron) operably linked to a mouse Prm1 promoter and a neomycin resistance gene operably linked to a human ubiquitin promoter. By employing the Prm1 promoter, the self-deleting cassette can be deleted specifically in male germ cells of F0 animals. Exemplary selection markers include neomycin phosphotransferase (neo$^r$), hygromycin B phosphotransferase (hyg$^r$), puromycin-N-acetyltransferase (puro$^r$), blasticidin S deaminase (bsr$^r$), xanthine/guanine phosphoribosyl transferase (gpt), or herpes simplex virus thymidine kinase (HSV-k), or a combination thereof. The polynucleotide encoding the selection marker can be operably linked to a promoter active in a cell being targeted. Examples of promoters are described elsewhere herein.

The nucleic acid construct can also comprise a reporter gene. Exemplary reporter genes include those encoding luciferase, β-galactosidase, green fluorescent protein (GFP), enhanced green fluorescent protein (eGFP), cyan fluorescent protein (CFP), yellow fluorescent protein (YFP), enhanced yellow fluorescent protein (eYFP), blue fluorescent protein (BFP), enhanced blue fluorescent protein (eBFP), DsRed, ZsGreen, MmGFP, mPlum, mCherry, tdTomato, mStrawberry, J-Red, mOrange, mKO, mCitrine, Venus, YPet, Emerald, CyPet, Cerulean, T-Sapphire, and alkaline phosphatase. Such reporter genes can be operably linked to a promoter active in a cell being targeted. Examples of promoters are described elsewhere herein.

The nucleic acid construct can also comprise one or more expression cassettes or deletion cassettes. A given cassette can comprise one or more of a nucleotide sequence of interest, a polynucleotide encoding a selection marker, and a reporter gene, along with various regulatory components that influence expression. Examples of selectable markers and reporter genes that can be included are discussed in detail elsewhere herein.

The nucleic acid construct can comprise a nucleic acid flanked with site-specific recombination target sequences.

Alternatively, the nucleic acid construct can comprise one or more site-specific recombination target sequences. Although the entire nucleic acid construct can be flanked by such site-specific recombination target sequences, any region or individual polynucleotide of interest within the nucleic acid construct can also be flanked by such sites. Site-specific recombination target sequences, which can flank the nucleic acid construct or any polynucleotide of interest in the nucleic acid construct can include, for example, loxP, lox511, lox2272, lox66, lox71, loxM2, lox5171, FRT, FRT11, FRT71, attp, att, FRT, rox, or a combination thereof. In one example, the site-specific recombination sites flank a polynucleotide encoding a selection marker and/or a reporter gene contained within the nucleic acid construct. Following integration of the nucleic acid construct at a targeted locus, the sequences between the site-specific recombination sites can be removed.

Nucleic acid constructs can also comprise one or more restriction sites for restriction endonucleases (i.e., restriction enzymes), which include Type I, Type II, Type III, and Type IV endonucleases. Type I and Type III restriction endonucleases recognize specific recognition sites, but typically cleave at a variable position from the nuclease binding site, which can be hundreds of base pairs away from the cleavage site (recognition site). In Type II systems the restriction activity is independent of any methylase activity, and cleavage typically occurs at specific sites within or near to the binding site. Most Type II enzymes cut palindromic sequences, however Type IIa enzymes recognize non-palindromic recognition sites and cleave outside of the recognition site, Type IIb enzymes cut sequences twice with both sites outside of the recognition site, and Type IIs enzymes recognize an asymmetric recognition site and cleave on one side and at a defined distance of about 1-20 nucleotides from the recognition site. Type IV restriction enzymes target methylated DNA. Restriction enzymes are further described and classified, for example in the REBASE database (webpage at rebase.neb.com; Roberts et al., (2003) *Nucleic Acids Res.* 31:418-420; Roberts et al., (2003) *Nucleic Acids Res.* 31:1805-1812; and Belfort et al. (2002) in Mobile DNA II, pp. 761-783, Eds. Craigie et al., (ASM Press, Washington, DC)).

The nucleic acid constructs disclosed herein can also comprise additional coding sequences. For example, some nucleic acid constructs disclosed herein can comprise a sequence encoding a guide RNA that targets the target genomic locus (e.g., that targets RS1, such as intron 1 of RS1). The sequence encoding the guide RNA can be operably linked to a promoter, such as a U6 promoter. In some nucleic acid constructs, the guide RNA expression cassette is located 3' (downstream) of the retinoschisin coding sequence(s). In some bidirectional nucleic acid constructs, the guide RNA expression cassette is located between the first segment and the second segment.

III. Vectors Comprising Nucleic Acid Constructs

Also provided herein are vectors comprising the nucleic acid constructs (i.e., exogenous donor nucleic acids) comprising a retinoschisin coding sequence (i.e., encoding a retinoschisin protein or fragment or variant thereof) for integration into and expression from a target genomic locus. Also provided herein are vectors comprising the nucleic acids encoding nuclease agents (e.g., targeting an endogenous RS1 locus) disclosed elsewhere herein. Also provided herein are vectors comprising the nucleic acid constructs and/or nucleic acids encoding nuclease agents (e.g., targeting an endogenous RS1 locus) disclosed elsewhere herein (e.g., vectors comprising the nucleic acid construct and a DNA encoding a guide RNA). A vector can comprise additional sequences such as, for example, replication origins, promoters, and genes encoding antibiotic resistance. Some such vectors comprise homology arms corresponding to target sites in the target genomic locus. Other such vectors do not comprise any homology arms.

Some vectors may be circular. Alternatively, the vector may be linear. The vector can be in the packaged for delivered via a lipid nanoparticle, liposome, non-lipid nanoparticle, or viral capsid. Non-limiting exemplary vectors include plasmids, phagemids, cosmids, artificial chromosomes, minichromosomes, transposons, viral vectors, and expression vectors.

The vectors can be, for example, viral vectors such as adeno-associated virus (AAV) vectors. The AAV may be any suitable serotype and may be a single-stranded AAV (ssAAV) or a self-complementary AAV (scAAV). Other exemplary viruses/viral vectors include retroviruses, adenoviruses, vaccinia viruses, poxviruses, and herpes simplex viruses. The viruses can infect dividing cells, non-dividing cells, or both dividing and non-dividing cells. The viruses can integrate into the host genome or alternatively do not integrate into the host genome. Such viruses can also be engineered to have reduced immunity. The viruses can be replication-competent or can be replication-defective (e.g., defective in one or more genes necessary for additional rounds of virion replication and/or packaging). Viruses can cause transient expression, long-lasting expression (e.g., at least 1 week, 2 weeks, 1 month, 2 months, or 3 months), or permanent expression (e.g., of Cas9 and/or gRNA). Exemplary viral titers (e.g., AAV titers) include $10^{12}$, $10^{13}$, $10^{14}$, $10^{15}$, and $10^{16}$ vector genomes/mL. Exemplary viral titers (e.g., AAV titers) include about $10^{12}$, about $10^{13}$, about $10^{14}$, about $10^{15}$, and about $10^{16}$ vector genomes (vg)/mL, or between about $10^{12}$ to about $10^{16}$, between about $10^{12}$ to about $10^{15}$, between about $10^{12}$ to about $10^{14}$, between about $10^{12}$ to about $10^{13}$, between about $10^{13}$ to about $10^{16}$, between about $10^{14}$ to about $10^{16}$, between about $10^{15}$ to about $10^{16}$, or between about $10^{13}$ to about $10^{15}$ vg/mL. Other exemplary viral titers (e.g., AAV titers) include about $10^{12}$, about $10^{13}$, about $10^{14}$, about $10^{15}$, and about $10^{16}$ vector genomes (vg)/kg of body weight, or between about $10^{12}$ to about $10^{16}$, between about $10^{12}$ to about $10^{15}$, between about $10^{12}$ to about $10^{14}$, between about $10^{12}$ to about $10^{13}$, between about $10^{13}$ to about $10^{16}$, between about $10^{14}$ to about $10^{16}$, between about $10^{15}$ to about $10^{16}$, or between about $10^{13}$ to about $10^{15}$ vg/kg of body weight.

The ssDNA AAV genome consists of two open reading frames, Rep and Cap, flanked by two inverted terminal repeats that allow for synthesis of the complementary DNA strand. When constructing an AAV transfer plasmid, the transgene is placed between the two ITRs, and Rep and Cap can be supplied in trans. In addition to Rep and Cap, AAV can require a helper plasmid containing genes from adenovirus. These genes (E4, E2a, and VA) mediate AAV replication. For example, the transfer plasmid, Rep/Cap, and the helper plasmid can be transfected into HEK293 cells containing the adenovirus gene E1+ to produce infectious AAV particles. Alternatively, the Rep, Cap, and adenovirus helper genes may be combined into a single plasmid. Similar packaging cells and methods can be used for other viruses, such as retroviruses.

Multiple serotypes of AAV have been identified. These serotypes differ in the types of cells they infect (i.e., their tropism), allowing preferential transduction of specific cell types. Serotypes for photoreceptor cells include AAV2, AAV5, and AAV8. Serotypes for retinal pigment epithelium tissue include AAV1, AAV2, AAV4, AAV5, and AAV8. In a specific example, the AAV vector comprising the nucleic acid construct can be AAV2, AAV5, or AAV8.

Tropism can be further refined through pseudotyping, which is the mixing of a capsid and a genome from different viral serotypes. For example AAV2/5 indicates a virus containing the genome of serotype 2 packaged in the capsid from serotype 5. Use of pseudotyped viruses can improve transduction efficiency, as well as alter tropism. Hybrid capsids derived from different serotypes can also be used to alter viral tropism. For example, AAV-DJ contains a hybrid capsid from eight serotypes and displays high infectivity across a broad range of cell types in vivo. AAV-DJ8 is another example that displays the properties of AAV-DJ but with enhanced brain uptake. AAV serotypes can also be modified through mutations. Examples of mutational modifications of AAV2 include Y444F, Y500F, Y730F, and S662V. Examples of mutational modifications of AAV3 include Y705F, Y731F, and T492V. Examples of mutational modifications of AAV6 include S663V and T492V. Other pseudotyped/modified AAV variants include AAV2/1, AAV2/6, AAV2/7, AAV2/8, AAV2/9, AAV2.5, AAV8.2, and AAV/SASTG. In a specific example, the AAV is AAV7m8, an AAV variant that mediates highly efficient delivery to all retinal layers and to photoreceptors. See, e.g., Dalkara et al. (2013) *Sci. Transl. Med.* 5:189ra76, herein incorporated by reference in its entirety for all purposes.

To accelerate transgene expression, self-complementary AAV (scAAV) variants can be used. Because AAV depends on the cell's DNA replication machinery to synthesize the complementary strand of the AAV's single-stranded DNA genome, transgene expression may be delayed. To address this delay, scAAV containing complementary sequences that are capable of spontaneously annealing upon infection can be used, eliminating the requirement for host cell DNA synthesis. However, single-stranded AAV (ssAAV) vectors can also be used.

To increase packaging capacity, longer transgenes may be split between two AAV transfer plasmids, the first with a 3' splice donor and the second with a 5' splice acceptor. Upon co-infection of a cell, these viruses form concatemers, are spliced together, and the full-length transgene can be expressed. Although this allows for longer transgene expression, expression is less efficient. Similar methods for increasing capacity utilize homologous recombination. For example, a transgene can be divided between two transfer plasmids but with substantial sequence overlap such that co-expression induces homologous recombination and expression of the full-length transgene.

IV. Lipid Nanoparticles Comprising Nucleic Acid Constructs

Also provided herein are lipid nanoparticles comprising the nucleic acid constructs (i.e., exogenous donor nucleic acids) comprising a retinoschisin coding sequence (i.e., encoding a retinoschisin protein or fragment or variant thereof) for integration into and expression from a target genomic locus. Also provided herein are lipid nanoparticles comprising the nucleic acids encoding nuclease agents (e.g., targeting an endogenous RS1 locus) disclosed elsewhere herein. Also provided herein are lipid nanoparticles comprising the nucleic acid constructs and the nucleic acids encoding nuclease agents (e.g., targeting an endogenous RS1 locus) disclosed elsewhere herein.

Lipid formulations can protect biological molecules from degradation while improving their cellular uptake. Lipid nanoparticles are particles comprising a plurality of lipid molecules physically associated with each other by intermolecular forces. These include microspheres (including unilamellar and multilamellar vesicles, e.g., liposomes), a dispersed phase in an emulsion, micelles, or an internal phase in a suspension. Such lipid nanoparticles can be used to encapsulate one or more nucleic acids or proteins for delivery. Formulations which contain cationic lipids are useful for delivering polyanions such as nucleic acids. Other lipids that can be included are neutral lipids (i.e., uncharged or zwitterionic lipids), anionic lipids, helper lipids that enhance transfection, and stealth lipids that increase the length of time for which nanoparticles can exist in vivo. Examples of suitable cationic lipids, neutral lipids, anionic lipids, helper lipids, and stealth lipids can be found in WO 2016/010840 A1 and WO 2017/173054 A1, each of which is herein incorporated by reference in its entirety for all purposes. An exemplary lipid nanoparticle can comprise a cationic lipid and one or more other components. In one example, the other component can comprise a helper lipid such as cholesterol. In another example, the other components can comprise a helper lipid such as cholesterol and a neutral lipid such as DSPC. In another example, the other components can comprise a helper lipid such as cholesterol, an optional neutral lipid such as DSPC, and a stealth lipid such as S010, S024, S027, S031, or S033.

The LNP may contain one or more or all of the following: (i) a lipid for encapsulation and for endosomal escape; (ii) a neutral lipid for stabilization; (iii) a helper lipid for stabilization; and (iv) a stealth lipid. See, e.g., Finn et al. (2018) *Cell Rep.* 22(9):2227-2235 and WO 2017/173054 A1, each of which is herein incorporated by reference in its entirety for all purposes. In certain LNPs, the cargo can further comprise a nuclease agent. In certain LNPs, the cargo can further comprise a guide RNA or a nucleic acid encoding a guide RNA. In certain LNPs, the cargo can further comprise an mRNA encoding a Cas nuclease, such as Cas9, and a guide RNA or a nucleic acid encoding a guide RNA. In certain LNPs, the cargo can include an mRNA encoding a Cas nuclease, such as Cas9, a guide RNA or a nucleic acid encoding a guide RNA, and the nucleic acid construct.

The lipid for encapsulation and endosomal escape can be a cationic lipid. The lipid can also be a biodegradable lipid, such as a biodegradable ionizable lipid. One example of a suitable lipid is Lipid A or LP01, which is (9Z,12Z)-3-((4, 4-bis(octyloxy)butanoyl)oxy)-2-((((3-(diethylamino) propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z, 12Z)-octadeca-9,12-dienoate. See, e.g., Finn et al. (2018) *Cell Rep.* 22(9):2227-2235 and WO 2017/173054 A1, each of which is herein incorporated by reference in its entirety for all purposes. Another example of a suitable lipid is Lipid B, which is ((5-((dimethylamino)methyl)-1,3-phenylene)bis (oxy))bis(octane-8,1-diyl)bis(decanoate), also called ((5-((dimethylamino)methyl)-1,3-phenylene)bis(oxy))bis(octane-8,1-diyl)bis(decanoate). Another example of a suitable lipid is Lipid C, which is 2-((4-(((3-(dimethylamino) propoxy)carbonyl)oxy)hexadecanoyl)oxy)propane-1,3-diyl (9Z,9'Z,12Z,12'Z)-bis(octadeca-9,12-dienoate). Another example of a suitable lipid is Lipid D, which is 3-(((3-(dimethylamino)propoxy)carbonyl)oxy)-13-(octanoyloxy) tridecyl 3-octylundecanoate. Other suitable lipids include heptatriaconta-6,9,28,31-tetraen-19-yl 4-(dimethylamino) butanoate (also known as Dlin-MC3-DMA (MC3))).

Some such lipids suitable for use in the LNPs described herein are biodegradable in vivo. For example, LNPs comprising such a lipid include those where at least 75% of the lipid is cleared from the plasma within 8, 10, 12, 24, or 48 hours, or 3, 4, 5, 6, 7, or 10 days. As another example, at least 50% of the LNP is cleared from the plasma within 8, 10, 12, 24, or 48 hours, or 3, 4, 5, 6, 7, or 10 days.

Such lipids may be ionizable depending upon the pH of the medium they are in. For example, in a slightly acidic medium, the lipids may be protonated and thus bear a positive charge. Conversely, in a slightly basic medium, such as, for example, blood where pH is approximately 7.35, the lipids may not be protonated and thus bear no charge. In some embodiments, the lipids may be protonated at a pH of at least about 9, 9.5, or 10. The ability of such a lipid to bear a charge is related to its intrinsic pKa. For example, the lipid may, independently, have a pKa in the range of from about 5.8 to about 6.2.

Neutral lipids function to stabilize and improve processing of the LNPs. Examples of suitable neutral lipids include a variety of neutral, uncharged or zwitterionic lipids. Examples of neutral phospholipids suitable for use in the present disclosure include, but are not limited to, 5-heptadecylbenzene-1,3-diol (resorcinol), dipalmitoylphosphatidylcholine (DPPC), distearoylphosphatidylcholine (DSPC), phosphocholine (DOPC), dimyristoylphosphatidylcholine (DMPC), phosphatidylcholine (PLPC), 1,2-distearoyl-sn-glycero-3-phosphocholine (DAPC), phosphatidylethanolamine (PE), egg phosphatidylcholine (EPC), dilauryloylphosphatidylcholine (DLPC), dimyristoylphosphatidylcholine (DMPC), 1-myristoyl-2-palmitoyl phosphatidylcholine (MPPC), 1-palmitoyl-2-myristoyl phosphatidylcholine (PMPC), 1-palmitoyl-2-stearoyl phosphatidylcholine (PSPC), 1,2-diarachidoyl-sn-glycero-3-phosphocholine (DBPC), 1-stearoyl-2-palmitoyl phosphatidylcholine (SPPC), 1,2-dieicosenoyl-sn-glycero-3-phosphocholine (DEPC), palmitoyloleoyl phosphatidylcholine (POPC), lysophosphatidyl choline, dioleoyl phosphatidylethanolamine (DOPE), dilinoleoylphosphatidylcholine distearoylphosphatidylethanolamine (DSPE), dimyristoyl phosphatidylethanolamine (DMPE), dipalmitoyl phosphatidylethanolamine (DPPE), palmitoyloleoyl phosphatidylethanolamine (POPE), lyso-phosphatidylethanolamine, and combinations thereof. For example, the neutral phospholipid may be selected from the group consisting of distearoylphosphatidylcholine (DSPC) and dimyristoyl phosphatidyl ethanolamine (DMPE).

Helper lipids include lipids that enhance transfection. The mechanism by which the helper lipid enhances transfection can include enhancing particle stability. In certain cases, the helper lipid can enhance membrane fusogenicity. Helper lipids include steroids, sterols, and alkyl resorcinols. Examples of suitable helper lipids suitable include cholesterol, 5-heptadecylresorcinol, and cholesterol hemisuccinate. In one example, the helper lipid may be cholesterol or cholesterol hemisuccinate.

Stealth lipids include lipids that alter the length of time the nanoparticles can exist in vivo. Stealth lipids may assist in the formulation process by, for example, reducing particle aggregation and controlling particle size. Stealth lipids may modulate pharmacokinetic properties of the LNP. Suitable stealth lipids include lipids having a hydrophilic head group linked to a lipid moiety.

The hydrophilic head group of stealth lipid can comprise, for example, a polymer moiety selected from polymers based on PEG (sometimes referred to as poly(ethylene oxide)), poly(oxazoline), poly(vinyl alcohol), poly(glycerol), poly(N-vinylpyrrolidone), polyaminoacids, and poly N-(2-hydroxypropyl)methacrylamide. The term PEG means any polyethylene glycol or other polyalkylene ether polymer. In certain LNP formulations, the PEG, is a PEG-2K, also termed PEG 2000, which has an average molecular weight of about 2,000 daltons. See, e.g., WO 2017/173054 A1, herein incorporated by reference in its entirety for all purposes.

The lipid moiety of the stealth lipid may be derived, for example, from diacylglycerol or diacylglycamide, including those comprising a dialkylglycerol or dialkylglycamide group having alkyl chain length independently comprising from about C4 to about C40 saturated or unsaturated carbon atoms, wherein the chain may comprise one or more functional groups such as, for example, an amide or ester. The dialkylglycerol or dialkylglycamide group can further comprise one or more substituted alkyl groups.

As one example, the stealth lipid may be selected from PEG-dilauroylglycerol, PEG-dimyristoylglycerol (PEG-DMG), PEG-dipalmitoylglycerol, PEG-distearoylglycerol (PEG-DSPE), PEG-dilaurylglycamide, PEG-dimyristylglycamide, PEG-dipalmitoylglycamide, and PEG-distearoylglycamide, PEG-cholesterol (1-[8'-(Cholest-5-en-3[beta]-oxy)carboxamido-3',6'-dioxaoctanyl]carbamoyl-[omega]-methyl-poly(ethylene glycol), PEG-DMB (3,4-ditetradecoxylbenzyl-[omega]-methyl-poly(ethylene glycol)ether), 1,2-dimyristoyl-sn-glycero-3-phosphoethanolamine-N-[methoxy(polyethylene glycol)-2000](PEG2k-DMG), 1,2-distearoyl-sn-glycero-3-phosphoethanolamine-N-[methoxy(polyethylene glycol)-2000](PEG2k-DSPE), 1,2-distearoyl-sn-glycerol, methoxypoly ethylene glycol (PEG2k-DSG), poly(ethylene glycol)-2000-dimethacrylate (PEG2k-DMA), and 1,2-distearyloxypropyl-3-amine-N-[methoxy(polyethylene glycol)-2000](PEG2k-DSA). In one particular example, the stealth lipid may be PEG2k-DMG.

The LNPs can comprise different respective molar ratios of the component lipids in the formulation. The mol-% of the CCD lipid may be, for example, from about 30 mol-% to about 60 mol-%, from about 35 mol-% to about 55 mol-%, from about 40 mol-% to about 50 mol-%, from about 42 mol-% to about 47 mol-%, or about 45%. The mol-% of the helper lipid may be, for example, from about 30 mol-% to about 60 mol-%, from about 35 mol-% to about 55 mol-%, from about 40 mol-% to about 50 mol-%, from about 41 mol-% to about 46 mol-%, or about 44 mol-%. The mol-% of the neutral lipid may be, for example, from about 1 mol-% to about 20 mol-%, from about 5 mol-% to about 15 mol-%, from about 7 mol-% to about 12 mol-%, or about 9 mol-%. The mol-% of the stealth lipid may be, for example, from about 1 mol-% to about 10 mol-%, from about 1 mol-% to about 5 mol-%, from about 1 mol-% to about 3 mol-%, about 2 mol-%, or about 1 mol-%.

The LNPs can have different ratios between the positively charged amine groups of the biodegradable lipid (N) and the negatively charged phosphate groups (P) of the nucleic acid to be encapsulated. This may be mathematically represented by the equation N/P. For example, the N/P ratio may be from about 0.5 to about 100, from about 1 to about 50, from about 1 to about 25, from about 1 to about 10, from about 1 to about 7, from about 3 to about 5, from about 4 to about 5, about 4, about 4.5, or about 5.

In some LNPs, the cargo can comprise Cas mRNA and gRNA. The Cas mRNA and gRNAs can be in different ratios. For example, the LNP formulation can include a ratio of Cas mRNA to gRNA nucleic acid ranging from about 25:1 to about 1:25, ranging from about 10:1 to about 1:10, ranging from about 5:1 to about 1:5, or about 1:1. Alternatively, the LNP formulation can include a ratio of Cas mRNA to gRNA nucleic acid from about 1:1 to about 1:5, or about 10:1. Alternatively, the LNP formulation can include a ratio of Cas mRNA to gRNA nucleic acid of about 1:10, 25:1, 10:1, 5:1, 3:1, 1:1, 1:3, 1:5, 1:10, or 1:25. Alternatively, the LNP formulation can include a ratio of Cas mRNA to gRNA nucleic acid of from about 1:1 to about 1:2. In specific examples, the ratio of Cas mRNA to gRNA can be about 1:1 or about 1:2.

Exemplary dosing of LNPs includes about 0.1, about 0.25, about 0.3, about 0.5, about 1, about 2, about 3, about 4, about 5, about 6, about 8, or about 10 mg/kg body weight (mpk) or about 0.1 to about 10, about 0.25 to about 10, about 0.3 to about 10, about 0.5 to about 10, about 1 to about 10, about 2 to about 10, about 3 to about 10, about 4 to about 10, about 5 to about 10, about 6 to about 10, about 8 to about 10, about 0.1 to about 8, about 0.1 to about 6, about 0.1 to about 5, about 0.1 to about 4, about 0.1 to about 3, about 0.1 to about 2, about 0.1 to about 1, about 0.1 to about 0.5, about 0.1 to about 0.3, about 0.1 to about 0.25, about 0.25 to about 8, about 0.3 to about 6, about 0.5 to about 5, about 1 to about 5, or about 2 to about 3 mg/kg body weight with respect to total RNA (Cas9 mRNA and gRNA) cargo content. Such LNPs can be administered, for example, intravenously. In one example, LNP doses between about 0.01 mg/kg and about 10 mg/kg, between about 0.1 and about 10 mg/kg, or between about 0.01 and about 0.3 mg/kg can be used. For example, LNP doses of about 0.01, about 0.03, about 0.1, about 0.3, about 1, about 3, or about 10 mg/kg can be used. Additional exemplary dosing of LNPs includes about 0.1, about 0.25, about 0.3, about 0.5, about 1, about 2, about 3, about 4, about 5, about 6, about 8, or about 10 mg/kg (mpk) body weight or about 0.1 to about 10, about 0.25 to about 10, about 0.3 to about 10, about 0.5 to about 10, about 1 to about 10, about 2 to about 10, about 3 to about 10, about 4 to about 10, about 5 to about 10, about 6 to about 10, about 8 to about 10, about 0.1 to about 8, about 0.1 to about 6, about 0.1 to about 5, about 0.1 to about 4, about 0.1 to about 3, about 0.1 to about 2, about 0.1 to about 1, about 0.1 to about 0.5, about 0.1 to about 0.3, about 0.1 to about 0.25, about 0.25 to about 8, about 0.3 to about 6, about 0.5 to about 5, about 1 to about 5, or about 2 to about 3 mg/kg body weight with respect to total RNA (Cas9 mRNA and gRNA) cargo content. Such LNPs can be administered, for example, intravenously. In one example, LNP doses between about 0.01 mg/kg and about 10 mg/kg, between about 0.1 and about 10 mg/kg, or between about 0.01 and about 0.3 mg/kg can be used. For example, LNP doses of about 0.01, about 0.03, about 0.1, about 0.3, about 0.5, about 1, about 2, about 3, or about 10 mg/kg can be used. In another example, LNP doses between about 0.5 and about 10, between about 0.5 and about 5, between about 0.5 and about 3, between about 1 and about 10, between about 1 and about 5, between about 1 and about 3, or between about 1 and about 2 mg/kg can be used.

V. Compositions Comprising Nucleic Acid Constructs and/or a Nuclease Agent or a Nucleic Acid Encoding a Nuclease Agent Also provided herein are compositions comprising the nucleic acid constructs comprising a retinoschisin coding sequence (i.e., encoding a retinoschisin protein or fragment or variant thereof) for integration into and expression from a target genomic locus, vectors, or lipid nanoparticles disclosed herein and a nuclease agent or a nucleic acid encoding the nuclease agent. Also provided herein are compositions comprising the nucleic acid constructs comprising a retinoschisin coding sequence (i.e., encoding a retinoschisin protein or fragment or variant thereof) for integration into and expression from a target genomic locus, vectors, or lipid nanoparticles disclosed herein. Also provided herein are compositions comprising a nuclease agent or a nucleic acid encoding the nuclease agent (e.g., wherein the nuclease agent targets a RS1 gene or locus) or vectors or lipid nanoparticles comprising the nuclease agent or the nucleic acid encoding the nuclease agent. Such compositions can be, for example, for use in expressing retinoschisin in a cell or for use in integrating a coding sequence for a retinoschisin protein or fragment or variant thereof into a target genomic locus in a cell. Such compositions can also be, for example, for use in treating a subject with X-linked juvenile retinoschisis (XLRS). Such compositions can comprise a nucleic acid construct comprising the coding sequence for the retinoschisin protein or fragment thereof for integration into the target genomic locus (or a vector or lipid nanoparticle comprising the nucleic acid construct) and a nuclease agent or a nucleic acid encoding the nuclease agent, wherein the nuclease agent targets a nuclease target sequence in the target genomic locus. The nuclease agent can be a CRISPR/Cas system (e.g., a Cas protein and a guide RNA) or any other suitable nuclease agent. Examples of suitable nuclease agents are provided below.

A. CRISPR/Cas Systems

The methods and compositions disclosed herein can utilize Clustered Regularly Interspersed Short Palindromic Repeats (CRISPR)/CRISPR-associated (Cas) systems or components of such systems to modify a genome within a cell (e.g., an RS1 locus). CRISPR/Cas systems include transcripts and other elements involved in the expression of, or directing the activity of, Cas genes. A CRISPR/Cas system can be, for example, a type I, a type II, a type III system, or a type V system (e.g., subtype V-A or subtype V-B). The methods and compositions disclosed herein can employ CRISPR/Cas systems by utilizing CRISPR complexes (comprising a guide RNA (gRNA) complexed with a Cas protein) for site-directed binding or cleavage of nucleic acids.

CRISPR/Cas systems used in the compositions and methods disclosed herein can be non-naturally occurring. A "non-naturally occurring" system includes anything indicating the involvement of the hand of man, such as one or more components of the system being altered or mutated from their naturally occurring state, being at least substantially free from at least one other component with which they are naturally associated in nature or being associated with at least one other component with which they are not naturally associated. For example, some CRISPR/Cas systems employ non-naturally occurring CRISPR complexes comprising a gRNA and a Cas protein that do not naturally occur together, employ a Cas protein that does not occur naturally, or employ a gRNA that does not occur naturally.

1. Cas Proteins

Cas proteins generally comprise at least one RNA recognition or binding domain that can interact with guide RNAs. Cas proteins can also comprise nuclease domains (e.g., DNase domains or RNase domains), DNA-binding domains, helicase domains, protein-protein interaction domains, dimerization domains, and other domains. Some such domains (e.g., DNase domains) can be from a native Cas protein. Other such domains can be added to make a modified Cas protein. A nuclease domain possesses catalytic activity for nucleic acid cleavage, which includes the breakage of the covalent bonds of a nucleic acid molecule. Cleavage can produce blunt ends or staggered ends, and it can be single-stranded or double-stranded. For example, a wild type Cas9 protein will typically create a blunt cleavage product. Alternatively, a wild type Cpf1 protein (e.g., FnCpf1) can result in a cleavage product with a 5-nucleotide 5' overhang, with the cleavage occurring after the 18th base pair from the PAM sequence on the non-targeted strand and after the 23rd base on the targeted strand. A Cas protein can have full cleavage activity to create a double-strand break at a target genomic locus (e.g., a double-strand break with blunt ends), or it can be a nickase that creates a single-strand break at a target genomic locus.

Examples of Cas proteins include Cas1, Cas1B, Cas2, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof.

An exemplary Cas protein is a Cas9 protein or a protein derived from a Cas9 protein. Cas9 proteins are from a type II CRISPR/Cas system and typically share four key motifs with a conserved architecture. Motifs 1, 2, and 4 are RuvC-like motifs, and motif 3 is an HNH motif. Exemplary Cas9 proteins are from *Streptococcus pyogenes, Streptococcus thermophilus, Streptococcus sp., Staphylococcus aureus, Nocardiopsis dassonvillei, Streptomyces pristinaespiralis, Streptomyces viridochromogenes, Streptomyces viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Microscilla marina, Burkholderiales* bacterium, *Polaromonas naphthalenivorans, Polaromonas* sp., *Crocosphaera watsonii,* Cyanothece sp., *Microcystis aeruginosa, Synechococcus* sp., *Acetohalobium arabaticum, Ammonifex degensii, Caldicellulosiruptor becscii, Candidatus Desulforudis, Clostridium botulinum, Clostridium difficile, Finegoldia magna, Natranaerobius thermophilus, Pelotomaculum thermopropionicum, Acidithiobacillus caldus, Acidithiobacillus ferrooxidans, Allochromatium vinosum, Marinobacter* sp., *Nitrosococcus halophilus, Nitrosococcus watsoni, Pseudoalteromonas haloplanktis, Ktedonobacter racemifer, Methanohalobium evestigatum, Anabaena variabilis, Nodularia spumigena, Nostoc* sp., *Arthrospira maxima, Arthrospira platensis, Arthrospira* sp., *Lyngbya* sp., *Microcoleus chthonoplastes, Oscillatoria* sp., *Petrotoga mobilis, Thermosipho africanus, Acaryochloris marina, Neisseria meningitidis,* or *Campylobacter jejuni*. Additional examples of the Cas9 family members are described in WO 2014/131833, herein incorporated by reference in its entirety for all purposes. Cas9 from *S. pyogenes* (SpCas9) (e.g., assigned UniProt accession number Q99ZW2) is an exemplary Cas9 protein. An exemplary SpCas9 protein sequence is set forth in SEQ ID NO: 27 (encoded by the DNA sequence set forth in SEQ ID NO: 26). An exemplary SpCas9 cDNA sequence is set forth in SEQ ID NO: 28. Smaller Cas9 proteins (e.g., Cas9 proteins whose coding sequences are compatible with the maximum AAV packaging capacity when combined with a guide RNA coding sequence and regulatory elements for the Cas9 and guide RNA, such as SaCas9 and CjCas9 and Nme2Cas9) are other exemplary Cas9 proteins. For example, Cas9 from *S. aureus* (SaCas9) (e.g., assigned UniProt accession number J7RUA5) is another exemplary Cas9 protein. Likewise, Cas9 from *Campylobacter jejuni* (CjCas9) e.g., (assigned UniProt accession number Q0P897) is another exemplary Cas9 protein. See, e.g., Kim et al. (2017) *Nat. Commun.* 8:14500, herein incorporated by reference in its entirety for all purposes. SaCas9 is smaller than SpCas9, and CjCas9 is smaller than both SaCas9 and SpCas9. Cas9 from *Neisseria*

*meningitidis* (Nme2Cas9) is another exemplary Cas9 protein. See, e.g., Edraki et al. (2019) *Mol. Cell* 73(4):714-726, herein incorporated by reference in its entirety for all purposes. Cas9 proteins from *Streptococcus thermophilus* (e.g., *Streptococcus thermophilus* LMID-9 Cas9 encoded by the CRISPR1 locus (St1Cas9) or *Streptococcus thermophilus* Cas9 from the CRISPR3 locus (St3Cas9)) are other exemplary Cas9 proteins. Cas9 from *Francisella novicida* (FnCas9) or the RHA *Francisella novicida* Cas9 variant that recognizes an alternative PAM (E1369R/E1449H/R1556A substitutions) are other exemplary Cas9 proteins. These and other exemplary Cas9 proteins are reviewed, e.g., in Cebrian-Serrano and Davies (2017) *Mamm. Genome* 28(7): 247-261, herein incorporated by reference in its entirety for all purposes. Examples of Cas9 coding sequences, Cas9 mRNAs, and Cas9 protein sequences are provided in WO 2013/176772, WO 2014/065596, WO 2016/106121, and WO 2019/067910, each of which is herein incorporated by reference in its entirety for all purposes. Specific examples of ORFs and Cas9 amino acid sequences are provided in Table 30 at paragraph [0449] WO 2019/067910, and specific examples of Cas9 mRNAs and ORFs are provided in paragraphs [0214]-[0234] of WO 2019/067910. As one example, a Cas9 protein can comprise, consist essentially of, or consist of the sequence set forth in SEQ ID NO: 6242. Such a Cas9 protein can be encoded by a mRNA comprising, consisting essentially of, or consisting of SEQ ID NO: 6243. As another example, a Cas9 protein can comprise, consist essentially of, or consist of the sequence set forth in SEQ ID NO: 6246. Such a Cas9 protein can be encoded by a mRNA comprising, consisting essentially of, or consisting of SEQ ID NO: 6245.

Another example of a Cas protein is a Cpf1 (CRISPR from *Prevotella* and *Francisella* 1) protein. Cpf1 is a large protein (about 1300 amino acids) that contains a RuvC-like nuclease domain homologous to the corresponding domain of Cas9 along with a counterpart to the characteristic arginine-rich cluster of Cas9. However, Cpf1 lacks the HNH nuclease domain that is present in Cas9 proteins, and the RuvC-like domain is contiguous in the Cpf1 sequence, in contrast to Cas9 where it contains long inserts including the HNH domain. See, e.g., Zetsche et al. (2015) *Cell* 163(3): 759-771, herein incorporated by reference in its entirety for all purposes. Exemplary Cpf1 proteins are from *Francisella tularensis* 1, *Francisella tularensis* subsp. *novicida*, *Prevotella albensis*, Lachnospiraceae bacterium MC2017 1, *Butyrivibrio proteoclasticus*, Peregrinibacteria bacterium GW2011 GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus methanoplasma termitum*, *Eubacterium eligens*, *Moraxella bovoculi* 237, *Leptospira inadai*, Lachnospiraceae bacterium ND2006, *Porphyromonas crevioricanis* 3, *Prevotella disiens*, and *Porphyromonas macacae*. Cpf1 from *Francisella novicida* U112 (FnCpf1; assigned UniProt accession number A0Q7Q2) is an exemplary Cpf1 protein.

Cas proteins can be wild type proteins (i.e., those that occur in nature), modified Cas proteins (i.e., Cas protein variants), or fragments of wild type or modified Cas proteins. Cas proteins can also be active variants or fragments with respect to catalytic activity of wild type or modified Cas proteins. Active variants or fragments with respect to catalytic activity can comprise at least 80%, 85%, 90%, 91%, 92%, 93%, 94%, 95%, 96%, 97%, 98%, 99% or more sequence identity to the wild type or modified Cas protein or a portion thereof, wherein the active variants retain the ability to cut at a desired cleavage site and hence retain nick-inducing or double-strand-break-inducing activity. Assays for nick-inducing or double-strand-break-inducing activity are known and generally measure the overall activity and specificity of the Cas protein on DNA substrates containing the cleavage site.

Cas proteins can be modified to increase or decrease one or more of nucleic acid binding affinity, nucleic acid binding specificity, and enzymatic activity. Cas proteins can also be modified to change any other activity or property of the protein, such as stability. For example, one or more nuclease domains of the Cas protein can be modified, deleted, or inactivated, or a Cas protein can be truncated to remove domains that are not essential for the function of the protein or to optimize (e.g., enhance or reduce) the activity of or a property of the Cas protein.

One example of a modified Cas protein is the modified SpCas9-HF1 protein, which is a high-fidelity variant of *Streptococcus pyogenes* Cas9 harboring alterations (N497A/ R661A/Q695A/Q926A) designed to reduce non-specific DNA contacts. See, e.g., Kleinstiver et al. (2016) *Nature* 529(7587):490-495, herein incorporated by reference in its entirety for all purposes. Another example of a modified Cas protein is the modified eSpCas9 variant (K848A/K1003A/ R1060A) designed to reduce off-target effects. See, e.g., Slaymaker et al. (2016) *Science* 351(6268):84-88, herein incorporated by reference in its entirety for all purposes. Other SpCas9 variants include K855A and K810A/K1003A/ R1060A. These and other modified Cas proteins are reviewed, e.g., in Cebrian-Serrano and Davies (2017) *Mamm. Genome* 28(7):247-261, herein incorporated by reference in its entirety for all purposes. Another example of a modified Cas9 protein is xCas9, which is a SpCas9 variant that can recognize an expanded range of PAM sequences. See, e.g., Hu et al. (2018) *Nature* 556:57-63, herein incorporated by reference in its entirety for all purposes.

Cas proteins can comprise at least one nuclease domain, such as a DNase domain. For example, a wild type Cpf1 protein generally comprises a RuvC-like domain that cleaves both strands of target DNA, perhaps in a dimeric configuration. Cas proteins can also comprise at least two nuclease domains, such as DNase domains. For example, a wild type Cas9 protein generally comprises a RuvC-like nuclease domain and an HNH-like nuclease domain. The RuvC and HNH domains can each cut a different strand of double-stranded DNA to make a double-stranded break in the DNA. See, e.g., Jinek et al. (2012) *Science* 337:816-821, herein incorporated by reference in its entirety for all purposes.

One or more or all of the nuclease domains can be deleted or mutated so that they are no longer functional or have reduced nuclease activity. For example, if one of the nuclease domains is deleted or mutated in a Cas9 protein, the resulting Cas9 protein can be referred to as a nickase and can generate a single-strand break within a double-stranded target DNA but not a double-strand break (i.e., it can cleave the complementary strand or the non-complementary strand, but not both). If both of the nuclease domains are deleted or mutated, the resulting Cas protein (e.g., Cas9) will have a reduced ability to cleave both strands of a double-stranded DNA (e.g., a nuclease-null or nuclease-inactive Cas protein, or a catalytically dead Cas protein (dCas)). If none of the nuclease domains is deleted or mutated in a Cas9 protein, the Cas9 protein will retain double-strand-break-inducing activity. An example of a mutation that converts Cas9 into a nickase is a D10A (aspartate to alanine at position 10 of Cas9) mutation in the RuvC domain of Cas9 from *S. pyogenes*. Likewise, H939A (histidine to alanine at amino acid position 839), H840A (histidine to alanine at amino acid position 840), or N863A (asparagine to alanine at amino acid position N863) in the HNH domain of Cas9 from *S. pyogenes* can convert the Cas9 into a nickase. Other examples of mutations that convert Cas9 into a nickase include the corresponding mutations to Cas9 from *S. thermophilus*. See, e.g., Sapranauskas et al. (2011) *Nucleic Acids Res.* 39(21): 9275-9282 and WO 2013/141680, each of which is herein incorporated by reference in its entirety for all purposes. Such mutations can be generated using methods such as site-directed mutagenesis, PCR-mediated mutagenesis, or total gene synthesis. Examples of other mutations creating nickases can be found, for example, in WO 2013/176772 and WO 2013/142578, each of which is herein incorporated by reference in its entirety for all purposes. If all of the nuclease domains are deleted or mutated in a Cas protein (e.g., both of the nuclease domains are deleted or mutated in a Cas9 protein), the resulting Cas protein (e.g., Cas9) will have a reduced ability to cleave both strands of a double-stranded DNA (e.g., a nuclease-null or nuclease-inactive Cas protein). One specific example is a D10A/H840A *S. pyogenes* Cas9 double mutant or a corresponding double mutant in a Cas9 from another species when optimally aligned with *S. pyogenes* Cas9. Another specific example is a D10A/N863A *S. pyogenes* Cas9 double mutant or a corresponding double mutant in a Cas9 from another species when optimally aligned with *S. pyogenes* Cas9.

Examples of inactivating mutations in the catalytic domains of xCas9 are the same as those described above for SpCas9. Examples of inactivating mutations in the catalytic domains of *Staphylococcus aureus* Cas9 proteins are also known. For example, the *Staphylococcus aureus* Cas9 enzyme (SaCas9) may comprise a substitution at position N580 (e.g., N580A substitution) and a substitution at position D10 (e.g., D10A substitution) to generate a nuclease-inactive Cas protein. See, e.g., WO 2016/106236, herein incorporated by reference in its entirety for all purposes. Examples of inactivating mutations in the catalytic domains of Nme2Cas9 are also known (e.g., combination of D16A and H588A). Examples of inactivating mutations in the catalytic domains of St1Cas9 are also known (e.g., combination of D9A, D598A, H599A, and N622A). Examples of inactivating mutations in the catalytic domains of St3Cas9 are also known (e.g., combination of D10A and N870A). Examples of inactivating mutations in the catalytic domains of CjCas9 are also known (e.g., combination of D8A and H559A). Examples of inactivating mutations in the catalytic domains of FnCas9 and RHA FnCas9 are also known (e.g., N995A).

Examples of inactivating mutations in the catalytic domains of Cpf1 proteins are also known. With reference to Cpf1 proteins from *Francisella novicida* U112 (FnCpf1), *Acidaminococcus* sp. BV3L6 (AsCpf1), Lachnospiraceae bacterium ND2006 (LbCpf1), and *Moraxella* bovoculi 237 (MbCpf1 Cpf1), such mutations can include mutations at positions 908, 993, or 1263 of AsCpf1 or corresponding positions in Cpf1 orthologs, or positions 832, 925, 947, or 1180 of LbCpf1 or corresponding positions in Cpf1 orthologs. Such mutations can include, for example one or more of mutations D908A, E993A, and D1263A of AsCpf1 or corresponding mutations in Cpf1 orthologs, or D832A, E925A, D947A, and D1180A of LbCpf1 or corresponding mutations in Cpf1 orthologs. See, e.g., US 2016/0208243, herein incorporated by reference in its entirety for all purposes.

Cas proteins can also be operably linked to heterologous polypeptides as fusion proteins. For example, a Cas protein can be fused to a cleavage domain or an epigenetic modification domain. See WO 2014/089290, herein incorporated by reference in its entirety for all purposes. Cas proteins can also be fused to a heterologous polypeptide providing increased or decreased stability. The fused domain or heterologous polypeptide can be located at the N-terminus, the C-terminus, or internally within the Cas protein.

As one example, a Cas protein can be fused to one or more heterologous polypeptides that provide for subcellular localization. Such heterologous polypeptides can include, for example, one or more nuclear localization signals (NLS) such as the monopartite SV40 NLS and/or a bipartite alpha-importin NLS for targeting to the nucleus, a mitochondrial localization signal for targeting to the mitochondria, an ER retention signal, and the like. See, e.g., Lange et al. (2007) *J. Biol. Chem.* 282(8):5101-5105, herein incorporated by reference in its entirety for all purposes. Such subcellular localization signals can be located at the N-terminus, the C-terminus, or anywhere within the Cas protein. An NLS can comprise a stretch of basic amino acids and can be a monopartite sequence or a bipartite sequence. Optionally, a Cas protein can comprise two or more NLSs, including an NLS (e.g., an alpha-importin NLS or a monopartite NLS) at the N-terminus and an NLS (e.g., an SV40 NLS or a bipartite NLS) at the C-terminus. A Cas protein can also comprise two or more NLSs at the N-terminus and/or two or more NLSs at the C-terminus.

A Cas protein may, for example, be fused with 1-10 NLSs (e.g., fused with 1-5 NLSs or fused with one NLS. Where one NLS is used, the NLS may be linked at the N-terminus or the C-terminus of the Cas protein sequence. It may also be inserted within the Cas protein sequence. Alternatively, the Cas protein may be fused with more than one NLS. For example, the Cas protein may be fused with 2, 3, 4, or 5 NLSs. In a specific example, the Cas protein may be fused with two NLSs. In certain circumstances, the two NLSs may be the same (e.g., two SV40 NLSs) or different. For example, the Cas protein can be fused to two SV40 NLS sequences linked at the carboxy terminus. Alternatively, the Cas protein may be fused with two NLSs, one linked at the N-terminus and one at the C-terminus. In other examples, the Cas protein may be fused with 3 NLSs or with no NLS. The NLS may be a monopartite sequence, such as, e.g., the SV40 NLS, PKKKRKV (SEQ ID NO: 49) or PKKKRRV (SEQ ID NO: 50). The NLS may be a bipartite sequence, such as the NLS of nucleoplasmin, KRPAATKKAGQAKKKK (SEQ ID NO: 51). In a specific example, a single PKKKRKV (SEQ ID NO: 49) NLS may be linked at the C-terminus of the Cas protein. One or more linkers are optionally included at the fusion site.

Cas proteins can also be operably linked to a cell-penetrating domain or protein transduction domain. For example, the cell-penetrating domain can be derived from the HIV-1 TAT protein, the TLM cell-penetrating motif from human hepatitis B virus, MPG, Pep-1, VP22, a cell penetrating peptide from Herpes simplex virus, or a polyarginine peptide sequence. See, e.g., WO 2014/089290 and WO 2013/176772, each of which is herein incorporated by reference in its entirety for all purposes. The cell-penetrating domain can be located at the N-terminus, the C-terminus, or anywhere within the Cas protein.

Cas proteins can also be operably linked to a heterologous polypeptide for ease of tracking or purification, such as a fluorescent protein, a purification tag, or an epitope tag. Examples of fluorescent proteins include green fluorescent proteins (e.g., GFP, GFP-2, tagGFP, turboGFP, eGFP, Emerald, Azami Green, Monomeric Azami Green, CopGFP, AceGFP, ZsGreenl), yellow fluorescent proteins (e.g., YFP, eYFP, Citrine, Venus, YPet, PhiYFP, ZsYellowl), blue fluorescent proteins (e.g., eBFP, eBFP2, Azurite, mKalamal, GFPuv, Sapphire, T-sapphire), cyan fluorescent proteins (e.g., eCFP, Cerulean, CyPet, AmCyanl, Midoriishi-Cyan), red fluorescent proteins (e.g., mKate, mKate2, mPlum, DsRed monomer, mCherry, mRFP1, DsRed-Express, DsRed2, DsRed-Monomer, HcRed-Tandem, HcRedl, AsRed2, eqFP611, mRaspberry, mStrawberry, Jred), orange fluorescent proteins (e.g., mOrange, mKO, Kusabira-Orange, Monomeric Kusabira-Orange, mTangerine, tdTomato), and any other suitable fluorescent protein. Examples of tags include glutathione-S-transferase (GST), chitin binding protein (CBP), maltose binding protein, thioredoxin (TRX), poly(NANP), tandem affinity purification (TAP) tag, myc, AcV5, AU1, AU5, E, ECS, E2, FLAG, hemagglutinin (HA), nus, Softag 1, Softag 3, Strep, SBP, Glu-Glu, HSV, KT3, S, S1, T7, V5, VSV-G, histidine (His), biotin carboxyl carrier protein (BCCP), and calmodulin.

Cas proteins can also be tethered to labeled nucleic acids or donor sequences. Such tethering (i.e., physical linking) can be achieved through covalent interactions or noncovalent interactions, and the tethering can be direct (e.g., through direct fusion or chemical conjugation, which can be achieved by modification of cysteine or lysine residues on the protein or intein modification) or can be achieved through one or more intervening linkers or adapter molecules such as streptavidin or aptamers. See, e.g., Pierce et al. (2005) *Mini Rev. Med. Chem.* 5(1):41-55; Duckworth et al. (2007) *Angew. Chem. Int. Ed. Engl.* 46(46):8819-8822; Schaeffer and Dixon (2009) *Australian J. Chem.* 62(10): 1328-1332; Goodman et al. (2009) *Chembiochem.* 10(9): 1551-1557; and Khatwani et al. (2012) *Bioorg. Med. Chem.* 20(14):4532-4539, each of which is herein incorporated by reference in its entirety for all purposes. Noncovalent strategies for synthesizing protein-nucleic acid conjugates include biotin-streptavidin and nickel-histidine methods. Covalent protein-nucleic acid conjugates can be synthesized by connecting appropriately functionalized nucleic acids and proteins using a wide variety of chemistries. Some of these chemistries involve direct attachment of the oligonucleotide to an amino acid residue on the protein surface (e.g., a lysine amine or a cysteine thiol), while other more complex schemes require post-translational modification of the protein or the involvement of a catalytic or reactive protein domain. Methods for covalent attachment of proteins to nucleic acids can include, for example, chemical cross-linking of oligonucleotides to protein lysine or cysteine residues, expressed protein-ligation, chemoenzymatic methods, and the use of photoaptamers. The labeled nucleic acid or donor sequence can be tethered to the C-terminus, the N-terminus, or to an internal region within the Cas protein. In one example, the labeled nucleic acid or donor sequence is tethered to the C-terminus or the N-terminus of the Cas protein. Likewise, the Cas protein can be tethered to the 5' end, the 3' end, or to an internal region within the labeled nucleic acid or donor sequence. That is, the labeled nucleic acid or donor sequence can be tethered in any orientation and polarity. For example, the Cas protein can be tethered to the 5' end or the 3' end of the labeled nucleic acid or donor sequence.

Cas proteins can be provided in any form. For example, a Cas protein can be provided in the form of a protein, such as a Cas protein complexed with a gRNA. Alternatively, a Cas protein can be provided in the form of a nucleic acid encoding the Cas protein, such as an RNA (e.g., messenger RNA (mRNA)) or DNA. Optionally, the nucleic acid encoding the Cas protein can be codon optimized for efficient translation into protein in a particular cell or organism. For example, the nucleic acid encoding the Cas protein can be modified to substitute codons having a higher frequency of usage in a bacterial cell, a yeast cell, a human cell, a non-human cell, a mammalian cell, a rodent cell, a mouse cell, a rat cell, or any other host cell of interest, as compared to the naturally occurring polynucleotide sequence. When a nucleic acid encoding the Cas protein is introduced into the cell, the Cas protein can be transiently, conditionally, or constitutively expressed in the cell.

Cas proteins provided as mRNAs can be modified for improved stability and/or immunogenicity properties. The modifications may be made to one or more nucleosides within the mRNA. Examples of chemical modifications to mRNA nucleobases include pseudouridine, 1-methylpseudouridine, and 5-methyl-cytidine. For example, capped and polyadenylated Cas mRNA containing N1-methyl pseudouridine can be used. Likewise, Cas mRNAs can be modified by depletion of uridine using synonymous codons.

Nucleic acids encoding Cas proteins can be stably integrated in the genome of a cell and operably linked to a promoter active in the cell. Alternatively, nucleic acids encoding Cas proteins can be operably linked to a promoter in an expression construct. Expression constructs include any nucleic acid constructs capable of directing expression of a gene or other nucleic acid sequence of interest (e.g., a Cas gene) and which can transfer such a nucleic acid sequence of interest to a target cell. For example, the nucleic acid encoding the Cas protein can be in a vector comprising a DNA encoding a gRNA. Alternatively, it can be in a vector or plasmid that is separate from the vector comprising the DNA encoding the gRNA. Promoters that can be used in an expression construct include promoters active, for example, in one or more of a eukaryotic cell, a human cell, a non-human cell, a mammalian cell, a non-human mammalian cell, a rodent cell, a mouse cell, a rat cell, a pluripotent cell, an embryonic stem (ES) cell, an adult stem cell, a developmentally restricted progenitor cell, an induced pluripotent stem (iPS) cell, or a one-cell stage embryo. Such promoters can be, for example, conditional promoters, inducible promoters, constitutive promoters, or tissue-specific promoters. Optionally, the promoter can be a bidirectional promoter driving expression of both a Cas protein in one direction and a guide RNA in the other direction. Such bidirectional promoters can consist of (1) a complete, conventional, unidirectional Pol III promoter that contains 3 external control elements: a distal sequence element (DSE), a proximal sequence element (PSE), and a TATA box; and (2) a second basic Pol III promoter that includes a PSE and a TATA box fused to the 5' terminus of the DSE in reverse orientation. For example, in the H1 promoter, the DSE is adjacent to the PSE and the TATA box, and the promoter can be rendered bidirectional by creating a hybrid promoter in which transcription in the reverse direction is controlled by appending a PSE and TATA box derived from the U6 promoter. See, e.g., US 2016/0074535, herein incorporated by references in its entirety for all purposes. Use of a bidirectional promoter to express genes encoding a Cas protein and a guide RNA simultaneously allow for the generation of compact expression cassettes to facilitate delivery.

Different promoters can be used to drive Cas expression or Cas9 expression. In some methods, small promoters are used so that the Cas or Cas9 coding sequence can fit into an AAV construct. For example, Cas or Cas9 and one or more gRNAs (e.g., 1 gRNA or 2 gRNAs or 3 gRNAs or 4 gRNAs)

can be delivered via LNP-mediated delivery (e.g., in the form of RNA) or adeno-associated virus (AAV)-mediated delivery (e.g., AAV2-mediated delivery, AAV5-mediated delivery, AAV8-mediated delivery, or AAV7m8-mediated delivery). For example, the nuclease agent can be CRISPR/Cas9, and a Cas9 mRNA and a gRNA targeting an endogenous RS1 locus (e.g., intron 1 of RS1) can be delivered via LNP-mediated delivery, or a DNA encoding Cas9 and a DNA encoding a gRNA targeting an endogenous RS1 locus (e.g., intron 1 of RS1) can be delivered via AAV-mediated delivery. The Cas or Cas9 and the gRNA(s) can be delivered in a single AAV or via two separate AAVs. For example, a first AAV can carry a Cas or Cas9 expression cassette, and a second AAV can carry a gRNA expression cassette. Similarly, a first AAV can carry a Cas or Cas9 expression cassette, and a second AAV can carry two or more gRNA expression cassettes. Alternatively, a single AAV can carry a Cas or Cas9 expression cassette (e.g., Cas or Cas9 coding sequence operably linked to a promoter) and a gRNA expression cassette (e.g., gRNA coding sequence operably linked to a promoter). Similarly, a single AAV can carry a Cas or Cas9 expression cassette (e.g., Cas or Cas9 coding sequence operably linked to a promoter) and two or more gRNA expression cassettes (e.g., gRNA coding sequences operably linked to promoters). Different promoters can be used to drive expression of the gRNA, such as a U6 promoter or the small tRNA Gln. Likewise, different promoters can be used to drive Cas9 expression. For example, small promoters are used so that the Cas9 coding sequence can fit into an AAV construct. Similarly, small Cas9 proteins (e.g., SaCas9 or CjCas9 are used to maximize the AAV packaging capacity).

Cas proteins provided as mRNAs can be modified for improved stability and/or immunogenicity properties. The modifications may be made to one or more nucleosides within the mRNA. Examples of chemical modifications to mRNA nucleobases include pseudouridine, 1-methyl-pseudouridine, and 5-methyl-cytidine. mRNA encoding Cas proteins can also be capped. The cap can be, for example, a cap 1 structure in which the +1 ribonucleotide is methylated at the 2'O position of the ribose. The capping can, for example, give superior activity in vivo (e.g., by mimicking a natural cap), can result in a natural structure that reduce stimulation of the innate immune system of the host (e.g., can reduce activation of pattern recognition receptors in the innate immune system). mRNA encoding Cas proteins can also be polyadenylated (to comprise a poly(A) tail). mRNA encoding Cas proteins can also be modified to include pseudouridine (e.g., can be fully substituted with pseudouridine). As another example, capped and polyadenylated Cas mRNA containing N1-methyl pseudouridine can be used. As another example, Cas mRNA fully substituted with pseudouridine can be used (i.e., all standard uracil residues are replaced with pseudouridine, a uridine isomer in which the uracil is attached with a carbon-carbon bond rather than nitrogen-carbon). Likewise, Cas mRNAs can be modified by depletion of uridine using synonymous codons. For example, capped and polyadenylated Cas mRNA fully substituted with pseudouridine can be used.

Cas mRNAs can comprise a modified uridine at least at one, a plurality of, or all uridine positions. The modified uridine can be a uridine modified at the 5 position (e.g., with a halogen, methyl, or ethyl). The modified uridine can be a pseudouridine modified at the 1 position (e.g., with a halogen, methyl, or ethyl). The modified uridine can be, for example, pseudouridine, N1-methyl-pseudouridine, 5-methoxyuridine, 5-iodouridine, or a combination thereof. In some examples, the modified uridine is 5-methoxyuridine. In some examples, the modified uridine is 5-iodouridine. In some examples, the modified uridine is pseudouridine. In some examples, the modified uridine is N1-methyl-pseudouridine. In some examples, the modified uridine is a combination of pseudouridine and N1-methyl-pseudouridine. In some examples, the modified uridine is a combination of pseudouridine and 5-methoxyuridine. In some examples, the modified uridine is a combination of N1-methyl pseudouridine and 5-methoxyuridine. In some examples, the modified uridine is a combination of 5-iodouridine and N1-methyl-pseudouridine. In some examples, the modified uridine is a combination of pseudouridine and 5-iodouridine. In some examples, the modified uridine is a combination of 5-iodouridine and 5-methoxyuridine.

Cas mRNAs disclosed herein can also comprise a 5' cap, such as a Cap0, Cap1, or Cap2. A 5' cap is generally a 7-methylguanine ribonucleotide (which may be further modified, e.g., with respect to ARCA) linked through a 5'-triphosphate to the 5' position of the first nucleotide of the 5'-to-3' chain of the mRNA (i.e., the first cap-proximal nucleotide). In Cap0, the riboses of the first and second cap-proximal nucleotides of the mRNA both comprise a 2'-hydroxyl. In Cap1, the riboses of the first and second transcribed nucleotides of the mRNA comprise a 2'-methoxy and a 2'-hydroxyl, respectively. In Cap2, the riboses of the first and second cap-proximal nucleotides of the mRNA both comprise a 2'-methoxy. See, e.g., Katibah et al. (2014) *Proc. Natl. Acad. Sci. U.S.A.* 111(33):12025-30 and Abbas et al. (2017) *Proc. Natl. Acad. Sci. U.S.A.* 114(11):E2106-E2115, each of which is herein incorporated by reference in its entirety for all purposes. Most endogenous higher eukaryotic mRNAs, including mammalian mRNAs such as human mRNAs, comprise Cap1 or Cap2. Cap0 and other cap structures differing from Cap1 and Cap2 may be immunogenic in mammals, such as humans, due to recognition as non-self by components of the innate immune system such as IFIT-1 and IFIT-5, which can result in elevated cytokine levels including type I interferon. Components of the innate immune system such as IFIT-1 and IFIT-5 may also compete with eIF4E for binding of an mRNA with a cap other than Cap1 or Cap2, potentially inhibiting translation of the mRNA.

A cap can be included co-transcriptionally. For example, ARCA (anti-reverse cap analog; Thermo Fisher Scientific Cat. No. AM8045) is a cap analog comprising a 7-methylguanine 3'-methoxy-5'-triphosphate linked to the 5' position of a guanine ribonucleotide which can be incorporated in vitro into a transcript at initiation. ARCA results in a Cap0 cap in which the 2' position of the first cap-proximal nucleotide is hydroxyl. See, e.g., Stepinski et al. (2001) *RNA* 7:1486-1495, herein incorporated by reference in its entirety for all purposes.

CleanCap™ AG (m7G(5')ppp(5')(2'OMeA)pG; TriLink Biotechnologies Cat. No. N-7113) or CleanCap™ GG (m7G (5')ppp(5')(2'OMeG)pG; TriLink Biotechnologies Cat. No. N-7133) can be used to provide a Cap1 structure co-transcriptionally. 3'-O-methylated versions of CleanCap™ AG and CleanCap™ GG are also available from TriLink Biotechnologies as Cat. Nos. N-7413 and N-7433, respectively.

Alternatively, a cap can be added to an RNA post-transcriptionally. For example, Vaccinia capping enzyme is commercially available (New England Biolabs Cat. No. M2080S) and has RNA triphosphatase and guanylyltransferase activities, provided by its D1 subunit, and guanine methyltransferase, provided by its D12 subunit. As such, it can add a 7-methylguanine to an RNA, so as to give Cap0, in the presence of S-adenosyl methionine and GTP. See, e.g., Guo and Moss (1990) *Proc. Natl. Acad. Sci. U.S.A.* 87:4023-4027 and Mao and Shuman (1994) *J. Biol. Chem.* 269:24472-24479, each of which is herein incorporated by reference in its entirety for all purposes.

Cas mRNAs can further comprise a poly-adenylated (poly-A or poly(A) or poly-adenine) tail. The poly-A tail can, for example, comprise at least 20, at least 30, at least 40, at least 50, at least 60, at least 70, at least 80, at least 90, or at least 100 adenines, and optionally up to 300 adenines. For example, the poly-A tail can comprise 95, 96, 97, 98, 99, or 100 adenine nucleotides.

2. Guide RNAs

A "guide RNA" or "gRNA" is an RNA molecule that binds to a Cas protein (e.g., Cas9 protein) and targets the Cas protein to a specific location within a target DNA. Guide RNAs can comprise two segments: a "DNA-targeting segment" (also called "guide sequence") and a "protein-binding segment." "Segment" includes a section or region of a molecule, such as a contiguous stretch of nucleotides in an RNA. Some gRNAs, such as those for Cas9, can comprise two separate RNA molecules: an "activator-RNA" (e.g., tracrRNA) and a "targeter-RNA" (e.g., CRISPR RNA or crRNA). Other gRNAs are a single RNA molecule (single RNA polynucleotide), which can also be called a "single-molecule gRNA," a "single-guide RNA," or an "sgRNA." See, e.g., WO 2013/176772, WO 2014/065596, WO 2014/089290, WO 2014/093622, WO 2014/099750, WO 2013/142578, and WO 2014/131833, each of which is herein incorporated by reference in its entirety for all purposes. A guide RNA can refer to either a CRISPR RNA (crRNA) or the combination of a crRNA and a trans-activating CRISPR RNA (tracrRNA). The crRNA and tracrRNA can be associated as a single RNA molecule (single guide RNA or sgRNA) or in two separate RNA molecules (dual guide RNA or dgRNA). For Cas9, for example, a single-guide RNA can comprise a crRNA fused to a tracrRNA (e.g., via a linker). For Cpf1, for example, only a crRNA is needed to achieve binding to and/or cleavage of a target sequence. The terms "guide RNA" and "gRNA" include both double-molecule (i.e., modular) gRNAs and single-molecule gRNAs. In some of the methods and compositions disclosed herein, a gRNA is a *S. pyogenes* Cas9 gRNA or an equivalent thereof. In some of the methods and compositions disclosed herein, a gRNA is a *S. aureus* Cas9 gRNA or an equivalent thereof.

An exemplary two-molecule gRNA comprises a crRNA-like ("CRISPR RNA" or "targeter-RNA" or "crRNA" or "crRNA repeat") molecule and a corresponding tracrRNA-like ("trans-activating CRISPR RNA" or "activator-RNA" or "tracrRNA") molecule. A crRNA comprises both the DNA-targeting segment (single-stranded) of the gRNA and a stretch of nucleotides (i.e., the crRNA tail) that forms one half of the dsRNA duplex of the protein-binding segment of the gRNA. An example of a crRNA tail, located downstream (3') of the DNA-targeting segment, comprises, consists essentially of, or consists of GUUUUAGAGCUAUGCU (SEQ ID NO: 29) or GUUUUAGAGCUAUGCUGUUUUG (SEQ ID NO: 52). Any of the DNA-targeting segments disclosed herein can be joined to the 5' end of SEQ ID NO: 29 or 52 to form a crRNA.

A corresponding tracrRNA (activator-RNA) comprises a stretch of nucleotides that forms the other half of the dsRNA duplex of the protein-binding segment of the gRNA. A stretch of nucleotides of a crRNA are complementary to and hybridize with a stretch of nucleotides of a tracrRNA to form the dsRNA duplex of the protein-binding domain of the gRNA. As such, each crRNA can be said to have a corresponding tracrRNA. Exemplary tracrRNA sequences comprise, consist essentially of, or consist of

```
                                              (SEQ ID NO: 30)
AGCAUAGCAAGUUAAAAUAAGGCUAGUCCGUUAUCAACUUGAAAAAGUG

GCACCGAGUCGGUGCUUU, (SEQ ID NO: 31)
AAACAGCAUAGCAAGUUAAAAUAAGGCUAGUCCGUUAUCAACUUGAAAAG

AGUGCACCGAGUCGGUGCUUUU, or
                                              (SEQ ID NO: 32)
GUUGGAACCAUUCAAAACAGCAUAGCAAGUUAAAAUAAGGCUAGUCCGUU

AUCAACUUGAAAAAGUGGCACCGAGUCGGUGC.
```

In systems in which both a crRNA and a tracrRNA are needed, the crRNA and the corresponding tracrRNA hybridize to form a gRNA. In systems in which only a crRNA is needed, the crRNA can be the gRNA. The crRNA additionally provides the single-stranded DNA-targeting segment that hybridizes to the complementary strand of a target DNA. If used for modification within a cell, the exact sequence of a given crRNA or tracrRNA molecule can be designed to be specific to the species in which the RNA molecules will be used. See, e.g., Mali et al. (2013) *Science* 339(6121):823-826; Jinek et al. (2012) *Science* 337(6096):816-821; Hwang et al. (2013) *Nat. Biotechnol.* 31(3):227-229; Jiang et al. (2013) *Nat. Biotechnol.* 31(3):233-239; and Cong et al. (2013) *Science* 339(6121):819-823, each of which is herein incorporated by reference in its entirety for all purposes.

The DNA-targeting segment (crRNA) of a given gRNA comprises a nucleotide sequence that is complementary to a sequence on the complementary strand of the target DNA, as described in more detail below. The DNA-targeting segment of a gRNA interacts with the target DNA in a sequence-specific manner via hybridization (i.e., base pairing). As such, the nucleotide sequence of the DNA-targeting segment may vary and determines the location within the target DNA with which the gRNA and the target DNA will interact. The DNA-targeting segment of a subject gRNA can be modified to hybridize to any desired sequence within a target DNA. Naturally occurring crRNAs differ depending on the CRISPR/Cas system and organism but often contain a targeting segment of between 21 to 72 nucleotides length, flanked by two direct repeats (DR) of a length of between 21 to 46 nucleotides (see, e.g., WO 2014/131833, herein incorporated by reference in its entirety for all purposes). In the case of *S. pyogenes*, the DRs are 36 nucleotides long and the targeting segment is 30 nucleotides long. The 3' located DR is complementary to and hybridizes with the corresponding tracrRNA, which in turn binds to the Cas protein.

The DNA-targeting segment can have, for example, a length of at least about 12, at least about 15, at least about 17, at least about 18, at least about 19, at least about 20, at least about 25, at least about 30, at least about 35, or at least about 40 nucleotides. Such DNA-targeting segments can have, for example, a length from about 12 to about 100, from about 12 to about 80, from about 12 to about 50, from about 12 to about 40, from about 12 to about 30, from about 12 to about 25, or from about 12 to about 20 nucleotides. For example, the DNA targeting segment can be from about 15 to about 25 nucleotides (e.g., from about 17 to about 20 nucleotides, or about 17, 18, 19, or 20 nucleotides). See, e.g., US 2016/0024523, herein incorporated by reference in its entirety for all purposes. For Cas9 from *S. pyogenes*, a typical DNA-targeting segment is between 16 and 20 nucleotides in length or between 17 and 20 nucleotides in length. For Cas9 from *S. aureus*, a typical DNA-targeting segment is between 21 and 23 nucleotides in length. For Cpf1, a typical DNA-targeting segment is at least 16 nucleotides in length or at least 18 nucleotides in length.

In one example, the DNA-targeting segment can be about 20 nucleotides in length. However, shorter and longer sequences can also be used for the targeting segment (e.g., 15-25 nucleotides in length, such as 15, 16, 17, 18, 19, 20, 21, 22, 23, 24, or 25 nucleotides in length). The degree of identity between the DNA-targeting segment and the corresponding guide RNA target sequence (or degree of complementarity between the DNA-targeting segment and the other strand of the guide RNA target sequence) can be, for example, about 75%, about 80%, about 85%, about 90%, about 95%, about 96%, about 97%, about 98%, about 99%, or about 100%. The DNA-targeting segment and the corresponding guide RNA target sequence can contain one or more mismatches. For example, the DNA-targeting segment of the guide RNA and the corresponding guide RNA target sequence can contain 1-4, 1-3, 1-2, 1, 2, 3, or 4 mismatches (e.g., where the total length of the guide RNA target sequence is at least 17, at least 18, at least 19, or at least 20 or more nucleotides). For example, the DNA-targeting segment of the guide RNA and the corresponding guide RNA target sequence can contain 1-4, 1-3, 1-2, 1, 2, 3, or 4 mismatches where the total length of the guide RNA target sequence 20 nucleotides.

As one example, a guide RNA targeting an RS1 gene can comprise a DNA-targeting segment (i.e., guide sequence) comprising, consisting essentially of, or consisting of the sequence (DNA-targeting segment) set forth in any one of SEQ ID NOS: 3148-6241. Alternatively, a guide RNA targeting an RS1 gene can comprise a DNA-targeting segment comprising, consisting essentially of, or consisting of at least 17, at least 18, at least 19, or at least 20 contiguous nucleotides of the sequence (DNA-targeting segment) set forth in any one of SEQ ID NOS: 3148-6241. Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 3148-6241. Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 3148-6241. Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 3148-6241. Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 3148-6241. Alternatively, a guide RNA targeting an RS1 gene can comprise a DNA-targeting segment comprising, consisting essentially of, or consisting of a sequence that differs by no more than 3, no more than 2, or no more than 1 nucleotide from the sequence (DNA-targeting segment) set forth in any one of SEQ ID NOS: 3148-6241. Alternatively, a guide RNA targeting an RS1 gene can comprise a DNA-targeting segment comprising, consisting essentially of, or consisting of a sequence that differs by no more than 3, no more than 2, or no more than 1 nucleotide from at least 17, at least 18, at least 19, or at least 20 contiguous nucleotides of the sequence (DNA-targeting segment) set forth in any one of SEQ ID NOS: 3148-6241. Examples of such guide sequences are set forth in Tables 2 and 3.

The guide RNA can target a human RS1 gene. As one example, a guide RNA targeting an RS1 gene can comprise a DNA-targeting segment (i.e., guide sequence) comprising, consisting essentially of, or consisting of the sequence (DNA-targeting segment) set forth in any one of SEQ ID NOS: 3148-4989. Alternatively, a guide RNA targeting an RS1 gene can comprise a DNA-targeting segment comprising, consisting essentially of, or consisting of at least 17, at least 18, at least 19, or at least 20 contiguous nucleotides of the sequence (DNA-targeting segment) set forth in any one of SEQ ID NOS: 3148-4989. Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 3148-4989. Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 3148-4989. Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 3148-4989. Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 3148-4989. Alternatively, a guide RNA targeting an RS1 gene can comprise a DNA-targeting segment comprising, consisting essentially of, or consisting of a sequence that differs by no more than 3, no more than 2, or no more than 1 nucleotide from the sequence (DNA-targeting segment) set forth in any one of SEQ ID NOS: 3148-4989. Alternatively, a guide RNA targeting an RS1 gene can comprise a DNA-targeting segment comprising, consisting essentially of, or consisting of a sequence that differs by no more than 3, no more than 2, or no more than 1 nucleotide from at least 17, at least 18, at least 19, or at least 20 contiguous nucleotides of the sequence (DNA-targeting segment) set forth in any one of SEQ ID NOS: 3148-4989.

The guide RNA can target a human RS1 gene and be selected to avoid off-target effects. As one example, a guide RNA targeting an RS1 gene can comprise a DNA-targeting segment (i.e., guide sequence) comprising, consisting essentially of, or consisting of the sequence (DNA-targeting segment) set forth in any one of SEQ ID NOS: 3148-3151, 3154-3186, 3188-3247, and 3249-4351. Alternatively, a guide RNA targeting an RS1 gene can comprise a DNA-targeting segment comprising, consisting essentially of, or consisting of at least 17, at least 18, at least 19, or at least 20 contiguous nucleotides of the sequence (DNA-targeting segment) set forth in any one of SEQ ID NOS: 3148-3151, 3154-3186, 3188-3247, and 3249-4351. Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 3148-3151, 3154-3186, 3188-3247, and 3249-4351. Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 3148-3151, 3154-3186, 3188-3247, and 3249-4351. Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 3148-3151, 3154-3186, 3188-3247, and 3249-4351. Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 3148-3151, 3154-3186, 3188-3247, and 3249-4351. Alternatively, a guide RNA targeting an RS1 gene can comprise a DNA-targeting segment comprising, consisting essentially of, or consisting of a sequence that differs by no more than 3, no more than 2, or no more than 1 nucleotide from the sequence (DNA-targeting segment) set forth in any one of SEQ ID NOS: 3148-3151, 3154-3186, 3188-3247, and 3249-4351. Alternatively, a guide RNA targeting an RS1 gene can comprise a DNA-targeting segment comprising, consisting essentially of, or consisting of a sequence that differs by no more than 3, no more than 2, or no more than 1 nucleotide from at least 17, at least 18, at least 19, or at least 20 contiguous nucleotides of the sequence (DNA-targeting segment) set forth in any one of SEQ ID NOS: 3148-3151, 3154-3186, 3188-3247, and 3249-4351.

The guide RNA can target a human RS1 gene. As one example, a guide RNA targeting an RS1 gene can comprise a DNA-targeting segment (i.e., guide sequence) comprising, consisting essentially of, or consisting of the sequence (DNA-targeting segment) set forth in any one of SEQ ID NOS: 3150, 3151, 3159, 3675, 4297, and 4304. Alternatively, a guide RNA targeting an RS1 gene can comprise a DNA-targeting segment comprising, consisting essentially of, or consisting of at least 17, at least 18, at least 19, or at least 20 contiguous nucleotides of the sequence (DNA-targeting segment) set forth in any one of SEQ ID NOS: 3150, 3151, 3159, 3675, 4297, and 4304. Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 3150, 3151, 3159, 3675, 4297, and 4304. Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 3150, 3151, 3159, 3675, 4297, and 4304. Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 3150, 3151, 3159, 3675, 4297, and 4304. Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 3150, 3151, 3159, 3675, 4297, and 4304. Alternatively, a guide RNA targeting an RS1 gene can comprise a DNA-targeting segment comprising, consisting essentially of, or consisting of a sequence that differs by no more than 3, no more than 2, or no more than 1 nucleotide from the sequence (DNA-targeting segment) set forth in any one of SEQ ID NOS: 3150, 3151, 3159, 3675, 4297, and 4304. Alternatively, a guide RNA targeting an RS1 gene can comprise a DNA-targeting segment comprising, consisting essentially of, or consisting of a sequence that differs by no more than 3, no more than 2, or no more than 1 nucleotide from at least 17, at least 18, at least 19, or at least 20 contiguous nucleotides of the sequence (DNA-targeting segment) set forth in any one of SEQ ID NOS: 3150, 3151, 3159, 3675, 4297, and 4304.

The guide RNA can target a mouse Rs1 gene. As one example, a guide RNA targeting an RS1 gene can comprise a DNA-targeting segment (i.e., guide sequence) comprising, consisting essentially of, or consisting of the sequence (DNA-targeting segment) set forth in any one of SEQ ID NOS: 4990-6241 (e.g., SEQ ID NO: 5477 or 5981). Alternatively, a guide RNA targeting an RS1 gene can comprise a DNA-targeting segment comprising, consisting essentially of, or consisting of at least 17, at least 18, at least 19, or at least 20 contiguous nucleotides of the sequence (DNA-targeting segment) set forth in any one of SEQ ID NOS: 4990-6241 (e.g., SEQ ID NO: 5477 or 5981). Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 4990-6241 (e.g., SEQ ID NO: 5477 or 5981). Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to the sequence (DNA-targeting segment) set forth in any one of SEQ ID NOS: 4990-6241 (e.g., SEQ ID NO: 5477 or 5981). Alternatively, a guide RNA targeting an RS1 gene can comprise a DNA-targeting segment that is at least 75%, at least 80%, at least 85%, at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 4990-6241 (e.g., SEQ ID NO: 5477 or 5981). Alternatively, a guide RNA targeting an RS1 gene can comprise a DNA-targeting segment that is at least 90%, at least 91%, at least 92%, at least 93%, at least 94%, at least 95%, at least 96%, at least 97%, at least 98%, or at least 99% identical to at least 17, at least 18, at least 19, or at least 20 contiguous nucleotides of the sequence (DNA-targeting segment) set forth in any one of SEQ ID NOS: 4990-6241 (e.g., SEQ ID NO: 5477 or 5981). Alternatively, a guide RNA targeting an RS1 gene can comprise a DNA-targeting segment comprising, consisting essentially of, or consisting of a sequence that differs by no more than 3, no more than 2, or no more than 1 nucleotide from the sequence (DNA-targeting segment) set forth in any one of SEQ ID NOS: 4990-6241 (e.g., SEQ ID NO: 5477 or 5981). Alternatively, a guide RNA targeting an RS1 gene can comprise a DNA-targeting segment comprising, consisting essentially of, or consisting of a sequence that differs by no more than 3, no more than 2, or no more than 1 nucleotide from at least 17, at least 18, at least 19, or at least 20 contiguous nucleotides of the sequence (DNA-targeting segment) set forth in any one of SEQ ID NOS: 4990-6241 (e.g., SEQ ID NO: 5477 or 5981).

TracrRNAs can be in any form (e.g., full-length tracrRNAs or active partial tracrRNAs) and of varying lengths. They can include primary transcripts or processed forms. For example, tracrRNAs (as part of a single-guide RNA or as a separate molecule as part of a two-molecule gRNA) may comprise, consist essentially of, or consist of all or a portion of a wild type tracrRNA sequence (e.g., about or more than about 20, 26, 32, 45, 48, 54, 63, 67, 85, or more nucleotides of a wild type tracrRNA sequence). Examples of wild type tracrRNA sequences from *S. pyogenes* include 171-nucleotide, 89-nucleotide, 75-nucleotide, and 65-nucleotide versions. See, e.g., Deltcheva et al. (2011) *Nature* 471(7340):602-607; WO 2014/093661, each of which is herein incorporated by reference in its entirety for all purposes. Examples of tracrRNAs within single-guide RNAs (sgRNAs) include the tracrRNA segments found within +48, +54, +67, and +85 versions of sgRNAs, where "+n" indicates that up to the +n nucleotide of wild type tracrRNA is included in the sgRNA. See U.S. Pat. No. 8,697,359, herein incorporated by reference in its entirety for all purposes.

The percent complementarity between the DNA-targeting segment of the guide RNA and the complementary strand of the target DNA can be at least 60% (e.g., at least 65%, at least 70%, at least 75%, at least 80%, at least 85%, at least 90%, at least 95%, at least 97%, at least 98%, at least 99%, or 100%). The percent complementarity between the DNA-targeting segment and the complementary strand of the target DNA can be at least 60% over about 20 contiguous nucleotides. As an example, the percent complementarity between the DNA-targeting segment and the complementary strand of the target DNA can be 100% over the 14 contiguous nucleotides at the 5' end of the complementary strand of the target DNA and as low as 0% over the remainder. In such a case, the DNA-targeting segment can be considered to be 14 nucleotides in length. As another example, the percent complementarity between the DNA-targeting segment and the complementary strand of the target DNA can be 100% over the seven contiguous nucleotides at the 5' end of the complementary strand of the target DNA and as low as 0% over the remainder. In such a case, the DNA-targeting segment can be considered to be 7 nucleotides in length. In some guide RNAs, at least 17 nucleotides within the DNA-targeting segment are complementary to the complementary strand of the target DNA. For example, the DNA-targeting segment can be 20 nucleotides in length and can comprise 1, 2, or 3 mismatches with the complementary strand of the target DNA. In one example, the mismatches are not adjacent to the region of the complementary strand corresponding to the protospacer adjacent motif (PAM) sequence (i.e., the reverse complement of the PAM sequence) (e.g., the mismatches are in the 5' end of the DNA-targeting segment of the guide RNA, or the mismatches are at least 2, 3, 4, 5, 6, 7, 8, 9, 10, 11, 12, 13, 14, 15, 16, 17, 18, or 19 base pairs away from the region of the complementary strand corresponding to the PAM sequence).

The protein-binding segment of a gRNA can comprise two stretches of nucleotides that are complementary to one another. The complementary nucleotides of the protein-binding segment hybridize to form a double-stranded RNA duplex (dsRNA). The protein-binding segment of a subject gRNA interacts with a Cas protein, and the gRNA directs the bound Cas protein to a specific nucleotide sequence within target DNA via the DNA-targeting segment.

Single-guide RNAs can comprise a DNA-targeting segment and a scaffold sequence (i.e., the protein-binding or Cas-binding sequence of the guide RNA). For example, such guide RNAs can have a 5' DNA-targeting segment joined to a 3' scaffold sequence. Exemplary scaffold sequences comprise, consist essentially of, or consist of:

```
                                  (version 1; SEQ ID NO: 33)
GUUUUAGAGCUAGAAAUAGCAAGUUAAAAUAAGGCUAGUCCGUUAUCAA

CUUGAAAAAGUGGCACCGAGUCGGUGCU;

(version 2; SEQ ID NO: 34)
GUUGGAACCAUUCAAAACAGCAUAGCAAGUUAAAAUAAGGCUAGUCCGU

UAUCAACUUGAAAAAGUGGCACCGAGUCGGUGC;

(version 3; SEQ ID NO: 35)
GUUUUAGAGCUAGAAAUAGCAAGUUAAAAUAAGGCUAGUCCGUUAUCAA

CUUGAAAAAGUGGCACCGAGUCGGUGC;

(version 4; SEQ ID NO: 36)
GUUUAAGAGCUAUGCUGGAAACAGCAUAGCAAGUUUAAAUAAGGCUAGU

CCGUUAUCAACUUGAAAAAGUGGCACCGAGUCGGUGC;

(version 5; SEQ ID NO: 37)
GUUUUAGAGCUAGAAAUAGCAAGUUAAAAUAAGGCUAGUCCGUUAUCAA

CUUGAAAAAGUGGCACCGAGUCGGUGCUUUUUUU;

(version 6; SEQ ID NO: 38)
GUUUUAGAGCUAGAAAUAGCAAGUUAAAAUAAGGCUAGUCCGUUAUCAA

CUUGAAAAAGUGGCACCGAGUCGGUGCUUUU;

(version 7; SEQ ID NO: 39)
GUUUAAGAGCUAUGCUGGAAACAGCAUAGCAAGUUUAAAUAAGGCUAGU

CCGUUAUCAACUUGAAAAAGUGGCACCGAGUCGGUGCUUUUUU;
```

-continued or (version 8; SEQ ID NO: 53)
GUUUUAGAGCUAGAAAUAGCAAGUUAAAAUAAGGCUAGUCCGUUAUCAA
CUUGGCACCGAGUCGGUGC.

In some guile sgRNAs, the four terminal U residues of version 6 are not present. In some sgRNAs, only 1, 2, or 3 of the four terminal U residues of version 6 are present. Guide RNAs targeting any of the guide RNA target sequences disclosed herein can include, for example, a DNA-targeting segment on the 5' end of the guide RNA fused to any of the exemplary guide RNA scaffold sequences on the 3' end of the guide RNA. That is, any of the DNA-targeting segments disclosed herein can be joined to the 5' end of any one of the above scaffold sequences to form a single guide RNA (chimeric guide RNA).

Guide RNAs can include modifications or sequences that provide for additional desirable features (e.g., modified or regulated stability; subcellular targeting; tracking with a fluorescent label; a binding site for a protein or protein complex; and the like). That is, guide RNAs can include one or more modified nucleosides or nucleotides, or one or more non-naturally and/or naturally occurring components or configurations that are used instead of or in addition to the canonical A, G, C, and U residues. Examples of such modifications include, for example, a 5' cap (e.g., a 7-methylguanylate cap (m7G)); a 3' polyadenylated tail (i.e., a 3' poly(A) tail); a riboswitch sequence (e.g., to allow for regulated stability and/or regulated accessibility by proteins and/or protein complexes); a stability control sequence; a sequence that forms a dsRNA duplex (i.e., a hairpin); a modification or sequence that targets the RNA to a subcellular location (e.g., nucleus, mitochondria, chloroplasts, and the like); a modification or sequence that provides for tracking (e.g., direct conjugation to a fluorescent molecule, conjugation to a moiety that facilitates fluorescent detection, a sequence that allows for fluorescent detection, and so forth); a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like); and combinations thereof. Other examples of modifications include engineered stem loop duplex structures, engineered bulge regions, engineered hairpins 3' of the stem loop duplex structure, or any combination thereof. See, e.g., US 2015/0376586, herein incorporated by reference in its entirety for all purposes. A bulge can be an unpaired region of nucleotides within the duplex made up of the crRNA-like region and the minimum tracrRNA-like region. A bulge can comprise, on one side of the duplex, an unpaired 5'-XXXY-3' where X is any purine and Y can be a nucleotide that can form a wobble pair with a nucleotide on the opposite strand, and an unpaired nucleotide region on the other side of the duplex.

Unmodified nucleic acids can be prone to degradation. Exogenous nucleic acids can also induce an innate immune response. Modifications can help introduce stability and reduce immunogenicity. Guide RNAs can comprise modified nucleosides and modified nucleotides including, for example, one or more of the following: (1) alteration or replacement of one or both of the non-linking phosphate oxygens and/or of one or more of the linking phosphate oxygens in the phosphodiester backbone linkage (an exemplary backbone modification); (2) alteration or replacement of a constituent of the ribose sugar such as alteration or replacement of the 2' hydroxyl on the ribose sugar (an exemplary sugar modification); (3) replacement (e.g., wholesale replacement) of the phosphate moiety with dephospho linkers (an exemplary backbone modification); (4) modification or replacement of a naturally occurring nucleobase, including with a non-canonical nucleobase (an exemplary base modification); (5) replacement or modification of the ribose-phosphate backbone (an exemplary backbone modification); (6) modification of the 3' end or 5' end of the oligonucleotide (e.g., removal, modification or replacement of a terminal phosphate group or conjugation of a moiety, cap, or linker (such 3' or 5' cap modifications may comprise a sugar and/or backbone modification)); and (7) modification ore replacement of the sugar (an exemplary sugar modification). Other possible guide RNA modifications include modifications of or replacement of uracils or poly-uracil tracts. See, e.g., WO 2015/048577 and US 2016/0237455, each of which is herein incorporated by reference in its entirety for all purposes. Similar modifications can be made to Cas-encoding nucleic acids, such as Cas mRNAs. For example, Cas mRNAs can be modified by depletion of uridine using synonymous codons.

Chemical modifications such at hose listed above can be combined to provide modified gRNAs and/or mRNAs comprising residues (nucleosides and nucleotides) that can have two, three, four, or more modifications. For example, a modified residue can have a modified sugar and a modified nucleobase. In one example, every base of a gRNA is modified (e.g., all bases have a modified phosphate group, such as a phosphorothioate group). For example, all or substantially all of the phosphate groups of a gRNA can be replaced with phosphorothioate groups. Alternatively or additionally, a modified gRNA can comprise at least one modified residue at or near the 5' end. Alternatively or additionally, a modified gRNA can comprise at least one modified residue at or near the 3' end.

Some gRNAs comprise one, two, three or more modified residues. For example, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or 100% of the positions in a modified gRNA can be modified nucleosides or nucleotides.

Unmodified nucleic acids can be prone to degradation. Exogenous nucleic acids can also induce an innate immune response. Modifications can help introduce stability and reduce immunogenicity. Some gRNAs described herein can contain one or more modified nucleosides or nucleotides to introduce stability toward intracellular or serum-based nucleases. Some modified gRNAs described herein can exhibit a reduced innate immune response when introduced into a population of cells.

The gRNAs disclosed herein can comprise a backbone modification in which the phosphate group of a modified residue can be modified by replacing one or more of the oxygens with a different substituent. The modification can include the wholesale replacement of an unmodified phosphate moiety with a modified phosphate group as described herein. Backbone modifications of the phosphate backbone can also include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. The phosphorous atom in an unmodified phosphate group is achiral. However, replacement of one of the non-bridging oxygens with one of the above atoms or groups of atoms can render the phosphorous atom chiral. The stereogenic phosphorous atom can possess either the "R" configuration (Rp) or the "S" configuration (Sp). The backbone can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

The phosphate group can be replaced by non-phosphorus containing connectors in certain backbone modifications. In some embodiments, the charged phosphate group can be replaced by a neutral moiety. Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Scaffolds that mimic nucleic acids can also be constructed wherein the phosphate linker and ribose sugar are replaced by nuclease resistant nucleoside or nucleotide surrogates. Such modifications may comprise backbone and sugar modifications. In some embodiments, the nucleobases can be tethered by a surrogate backbone. Examples can include, without limitation, the morpholino, cyclobutyl, pyrrolidine and peptide nucleic acid (PNA) nucleoside surrogates.

The modified nucleosides and modified nucleotides can include one or more modifications to the sugar group (a sugar modification). For example, the 2' hydroxyl group (OH) can be modified (e.g., replaced with a number of different oxy or deoxy substituents. Modifications to the 2' hydroxyl group can enhance the stability of the nucleic acid since the hydroxyl can no longer be deprotonated to form a 2'-alkoxide ion.

Examples of 2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). The 2' hydroxyl group modification can be 2'-O-Me. Likewise, the 2' hydroxyl group modification can be a 2'-fluoro modification, which replaces the 2' hydroxyl group with a fluoride. The 2' hydroxyl group modification can include locked nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). The 2' hydroxyl group modification can include unlocked nucleic acids (UNA) in which the ribose ring lacks the C2'-C3' bond. The 2' hydroxyl group modification can include the methoxyethyl group (MOE), ($OCH_2CH_2OCH_3$, e.g., a PEG derivative).

Deoxy 2' modifications can include hydrogen (i.e. deoxyribose sugars, e.g., at the overhang portions of partially dsRNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar modification can comprise a sugar group which may also contain one or more carbons that possess the opposite stereochemical configuration than that of the corresponding carbon in ribose. Thus, a modified nucleic acid can include nucleotides containing e.g., arabinose, as the sugar. The modified nucleic acids can also include abasic sugars. These abasic sugars can also be further modified at one or more of the constituent sugar atoms. The modified nucleic acids can also include one or more sugars that are in the L form (e.g. L-nucleosides).

The modified nucleosides and modified nucleotides described herein, which can be incorporated into a modified nucleic acid, can include a modified base, also called a nucleobase. Examples of nucleobases include, but are not limited to, adenine (A), guanine (G), cytosine (C), and uracil (U). These nucleobases can be modified or wholly replaced to provide modified residues that can be incorporated into modified nucleic acids. The nucleobase of the nucleotide can be independently selected from a purine, a pyrimidine, a purine analog, or pyrimidine analog. In some embodiments, the nucleobase can include, for example, naturally-occurring and synthetic derivatives of a base.

In a dual guide RNA, each of the crRNA and the tracrRNA can contain modifications. Such modifications may be at one or both ends of the crRNA and/or tracrRNA. In a sgRNA, one or more residues at one or both ends of the sgRNA may be chemically modified, and/or internal nucleosides may be modified, and/or the entire sgRNA may be chemically modified. Some gRNAs comprise a 5' end modification. Some gRNAs comprise a 3' end modification.

The guide RNAs disclosed herein can comprise one of the modification patterns disclosed in WO 2018/107028 A1, herein incorporated by reference in its entirety for all purposes. The guide RNAs disclosed herein can also comprise one of the structures/modification patterns disclosed in US 2017/0114334, herein incorporated by reference in its entirety for all purposes. The guide RNAs disclosed herein can also comprise one of the structures/modification patterns disclosed in WO 2017/136794, WO 2017/004279, US 2018/0187186, or US 2019/0048338, each of which is herein incorporated by reference in its entirety for all purposes.

As one example, nucleotides at the 5' or 3' end of a guide RNA can include phosphorothioate linkages (e.g., the bases can have a modified phosphate group that is a phosphorothioate group). For example, a guide RNA can include phosphorothioate linkages between the 2, 3, or 4 terminal nucleotides at the 5' or 3' end of the guide RNA. As another example, nucleotides at the 5' and/or 3' end of a guide RNA can have 2'-O-methyl modifications. For example, a guide RNA can include 2'-O-methyl modifications at the 2, 3, or 4 terminal nucleotides at the 5' and/or 3' end of the guide RNA (e.g., the 5' end). See, e.g., WO 2017/173054 A1 and Finn et al. (2018) *Cell Rep.* 22(9):2227-2235, each of which is herein incorporated by reference in its entirety for all purposes. Other possible modifications are described in more detail elsewhere herein. In one specific example, the guide RNA includes 2'-O-methyl analogs and 3' phosphorothioate internucleotide linkages at the first three 5' and 3' terminal RNA residues. In another specific example, the guide RNA is modified such that all 2'OH groups that do not interact with the Cas9 protein are replaced with 2'-O-methyl analogs, and the tail region of the guide RNA, which has minimal interaction with Cas9, is modified with 5' and 3' phosphorothioate internucleotide linkages. Additionally, the DNA-targeting segment can have 2'-fluoro modifications on some bases. See, e.g., Yin et al. (2017) *Nat. Biotech.* 35(12):1179-1187, herein incorporated by reference in its entirety for all purposes. Other examples of modified guide RNAs are provided, e.g., in WO 2018/107028 A1, herein incorporated by reference in its entirety for all purposes. Such chemical modifications can, for example, provide greater stability and protection from exonucleases to guide RNAs, allowing them to persist within cells for longer than unmodified guide RNAs. Such chemical modifications can also, for example, protect against innate intracellular immune responses that can actively degrade RNA or trigger immune cascades that lead to cell death.

As one example, any of the guide RNAs described herein can comprise at least one modification. In one example, the at least one modification comprises a 2'-O-methyl (2'-O-Me) modified nucleotide, a phosphorothioate (PS) bond between nucleotides, a 2'-fluoro (2'-F) modified nucleotide, or a combination thereof. For example, the at least one modification can comprise a 2'-O-methyl (2'-O-Me) modified nucleotide. Alternatively or additionally, the at least one modification can comprise a phosphorothioate (PS) bond between nucleotides. Alternatively or additionally, the at least one modification can comprise a 2'-fluoro (2'-F) modified nucleotide. In one example, a guide RNA described herein comprises one or more 2'-O-methyl (2'-O-Me) modified nucleotides and one or more phosphorothioate (PS) bonds between nucleotides.

The modifications can occur anywhere in the guide RNA. As one example, the guide RNA comprises a modification at one or more of the first five nucleotides at the 5' end of the guide RNA, the guide RNA comprises a modification at one or more of the last five nucleotides of the 3' end of the guide RNA, or a combination thereof. For example, the guide RNA can comprise phosphorothioate bonds between the first four nucleotides of the guide RNA, phosphorothioate bonds between the last four nucleotides of the guide RNA, or a combination thereof. Alternatively or additionally, the guide RNA can comprise 2'-O-Me modified nucleotides at the first three nucleotides at the 5' end of the guide RNA, can comprise 2'-O-Me modified nucleotides at the last three nucleotides at the 3' end of the guide RNA, or a combination thereof.

In one example, a modified gRNA can comprise the following sequence: mN*mN*mN*NNNNNNNNNNNNN-NNNNGUUUUAGAmGmCmUmAmGmAmAmAmUmA mGmCAAGUUAAAAUAAGGCUAGUCCGUUAUCA-mAmCmUmUmGmAmAmAmAmAm GmUmGmGm-CmAmCmCmCmGmAmGmUmCmGmGmUmGmCmU*mU* mU*mU (SEQ ID NO: 44), where "N" may be any natural or non-natural nucleotide, and wherein the totality of N residues comprise an RS1 DNA-targeting segment as described herein (e.g., the sequence set forth in SEQ ID NO: 44, wherein the N residues are replaced with the DNA-targeting segment of any one of SEQ ID NOS: 3148-6241, or any one of SEQ ID NOS: 3148-4989, or any one of SEQ ID NOS: 3148-3151, 3154-3186, 3188-3247, and 3249-4351, or any one of SEQ ID NOS: 3150, 3151, 3159, 3675, 4297, and 4304, or any one of SEQ ID NOS: 4990-6241 (e.g., 5477 or 5981). The terms "mA," "mC," "mU," and "mG" denote a nucleotide (A, C, U, and G, respectively) that has been modified with 2'-O-Me. The symbol "*" depicts a phosphorothioate modification. A phosphorothioate linkage or bond refers to a bond where a sulfur is substituted for one nonbridging phosphate oxygen in a phosphodiester linkage, for example in the bonds between nucleotides bases. When phosphorothioates are used to generate oligonucleotides, the modified oligonucleotides may also be referred to as S-oligos. The terms A*, C*, U*, or G* denote a nucleotide that is linked to the next (e.g., 3') nucleotide with a phosphorothioate bond. The terms "mA*," "mC*," "mU*," and "mG*" denote a nucleotide (A, C, U, and G, respectively) that has been substituted with 2'-O-Me and that is linked to the next (e.g., 3') nucleotide with a phosphorothioate bond.

Another chemical modification that has been shown to influence nucleotide sugar rings is halogen substitution. For example, 2'-fluoro (2'-F) substitution on nucleotide sugar rings can increase oligonucleotide binding affinity and nuclease stability. Abasic nucleotides refer to those which lack nitrogenous bases. Inverted bases refer to those with linkages that are inverted from the normal 5' to 3' linkage (i.e., either a 5' to 5' linkage or a 3' to 3' linkage).

An abasic nucleotide can be attached with an inverted linkage. For example, an abasic nucleotide may be attached to the terminal 5' nucleotide via a 5' to 5' linkage, or an abasic nucleotide may be attached to the terminal 3' nucleotide via a 3' to 3' linkage. An inverted abasic nucleotide at either the terminal 5' or 3' nucleotide may also be called an inverted abasic end cap.

In one example, one or more of the first three, four, or five nucleotides at the 5' terminus, and one or more of the last three, four, or five nucleotides at the 3' terminus are modified. The modification can be, for example, a 2'-O-Me, 2'-F, inverted abasic nucleotide, phosphorothioate bond, or other nucleotide modification well known to increase stability and/or performance.

In another example, the first four nucleotides at the 5' terminus, and the last four nucleotides at the 3' terminus can be linked with phosphorothioate bonds.

In another example, the first three nucleotides at the 5' terminus, and the last three nucleotides at the 3' terminus can comprise a 2'-O-methyl (2'-O-Me) modified nucleotide. In another example, the first three nucleotides at the 5' terminus, and the last three nucleotides at the 3' terminus comprise a 2'-fluoro (2'-F) modified nucleotide. In another example, the first three nucleotides at the 5' terminus, and the last three nucleotides at the 3' terminus comprise an inverted abasic nucleotide.

Guide RNAs can be provided in any form. For example, the gRNA can be provided in the form of RNA, either as two molecules (separate crRNA and tracrRNA) or as one molecule (sgRNA), and optionally in the form of a complex with a Cas protein. The gRNA can also be provided in the form of DNA encoding the gRNA. The DNA encoding the gRNA can encode a single RNA molecule (sgRNA) or separate RNA molecules (e.g., separate crRNA and tracrRNA). In the latter case, the DNA encoding the gRNA can be provided as one DNA molecule or as separate DNA molecules encoding the crRNA and tracrRNA, respectively.

When a gRNA is provided in the form of DNA, the gRNA can be transiently, conditionally, or constitutively expressed in the cell. DNAs encoding gRNAs can be stably integrated into the genome of the cell and operably linked to a promoter active in the cell. Alternatively, DNAs encoding gRNAs can be operably linked to a promoter in an expression construct. For example, the DNA encoding the gRNA can be in a vector comprising a heterologous nucleic acid, such as a nucleic acid encoding a Cas protein. Alternatively, it can be in a vector or a plasmid that is separate from the vector comprising the nucleic acid encoding the Cas protein. Promoters that can be used in such expression constructs include promoters active, for example, in one or more of a eukaryotic cell, a human cell, a non-human cell, a mammalian cell, a non-human mammalian cell, a rodent cell, a mouse cell, a rat cell, a pluripotent cell, an embryonic stem (ES) cell, an adult stem cell, a developmentally restricted progenitor cell, an induced pluripotent stem (iPS) cell, or a one-cell stage embryo. Such promoters can be, for example, conditional promoters, inducible promoters, constitutive promoters, or tissue-specific promoters. Such promoters can also be, for example, bidirectional promoters. Specific examples of suitable promoters include an RNA polymerase III promoter, such as a human U6 promoter, a rat U6 polymerase III promoter, or a mouse U6 polymerase III promoter. In another example, the small tRNA Gln can be used to drive expression of a guide RNA.

Alternatively, gRNAs can be prepared by various other methods. For example, gRNAs can be prepared by in vitro transcription using, for example, T7 RNA polymerase (see, e.g., WO 2014/089290 and WO 2014/065596, each of which is herein incorporated by reference in its entirety for all purposes). Guide RNAs can also be a synthetically produced molecule prepared by chemical synthesis. For example, a guide RNA can be chemically synthesized to include 2'-O-methyl analogs and 3' phosphorothioate internucleotide linkages at the first three 5' and 3' terminal RNA residues.

Guide RNAs (or nucleic acids encoding guide RNAs) can be in compositions comprising one or more guide RNAs (e.g., 1, 2, 3, 4, or more guide RNAs) and a carrier increasing the stability of the guide RNA (e.g., prolonging the period under given conditions of storage (e.g., −20° C., 4° C., or ambient temperature) for which degradation products remain below a threshold, such below 0.5% by weight of the starting nucleic acid or protein; or increasing the stability in vivo). Non-limiting examples of such carriers include poly (lactic acid) (PLA) microspheres, poly(D,L-lactic-coglycolic-acid) (PLGA) microspheres, liposomes, micelles, inverse micelles, lipid cochleates, and lipid microtubules. Such compositions can further comprise a Cas protein, such as a Cas9 protein, or a nucleic acid encoding a Cas protein.

3. Guide RNA Target Sequences

Target DNAs for guide RNAs include nucleic acid sequences present in a DNA to which a DNA-targeting segment of a gRNA will bind, provided sufficient conditions for binding exist. Suitable DNA/RNA binding conditions include physiological conditions normally present in a cell. Other suitable DNA/RNA binding conditions (e.g., conditions in a cell-free system) are known in the art (see, e.g., Molecular Cloning: A Laboratory Manual, 3rd Ed. (Sambrook et al., Harbor Laboratory Press 2001), herein incorporated by reference in its entirety for all purposes). The strand of the target DNA that is complementary to and hybridizes with the gRNA can be called the "complementary strand," and the strand of the target DNA that is complementary to the "complementary strand" (and is therefore not complementary to the Cas protein or gRNA) can be called "noncomplementary strand" or "template strand."

The target DNA includes both the sequence on the complementary strand to which the guide RNA hybridizes and the corresponding sequence on the non-complementary strand (e.g., adjacent to the protospacer adjacent motif (PAM)). Unless otherwise specified, the term "guide RNA target sequence" as used herein refers specifically to the sequence on the non-complementary strand corresponding to (i.e., the reverse complement of) the sequence to which the guide RNA hybridizes on the complementary strand. That is, the guide RNA target sequence refers to the sequence on the non-complementary strand adjacent to the PAM (e.g., upstream or 5' of the PAM in the case of Cas9). A guide RNA target sequence is equivalent to the DNA-targeting segment of a guide RNA, but with thymines instead of uracils. As one example, a guide RNA target sequence for an SpCas9 enzyme can refer to the sequence upstream of the 5'-NGG-3' PAM on the non-complementary strand. A guide RNA is designed to have complementarity to the complementary strand of a target DNA, where hybridization between the DNA-targeting segment of the guide RNA and the complementary strand of the target DNA promotes the formation of a CRISPR complex. Full complementarity is not necessarily required, provided that there is sufficient complementarity to cause hybridization and promote formation of a CRISPR complex. If a guide RNA is referred to herein as targeting a guide RNA target sequence, what is meant is that the guide RNA hybridizes to the complementary strand sequence of the target DNA that is the reverse complement of the guide RNA target sequence on the non-complementary strand.

A target DNA or guide RNA target sequence can comprise any polynucleotide, and can be located, for example, in the nucleus or cytoplasm of a cell or within an organelle of a cell, such as a mitochondrion or chloroplast. A target DNA or guide RNA target sequence can be any nucleic acid sequence endogenous or exogenous to a cell. The guide RNA target sequence can be a sequence coding a gene product (e.g., a protein) or a non-coding sequence (e.g., a regulatory sequence) or can include both.

Site-specific binding and cleavage of a target DNA by a Cas protein can occur at locations determined by both (i) base-pairing complementarity between the guide RNA and the complementary strand of the target DNA and (ii) a short motif, called the protospacer adjacent motif (PAM), in the non-complementary strand of the target DNA. The PAM can flank the guide RNA target sequence. Optionally, the guide RNA target sequence can be flanked on the 3' end by the PAM (e.g., for Cas9). Alternatively, the guide RNA target sequence can be flanked on the 5' end by the PAM (e.g., for Cpf1). For example, the cleavage site of Cas proteins can be about 1 to about 10 or about 2 to about 5 base pairs (e.g., 3 base pairs) upstream or downstream of the PAM sequence (e.g., within the guide RNA target sequence). In the case of SpCas9, the PAM sequence (i.e., on the non-complementary strand) can be 5'-$N_1$GG-3', where $N_1$ is any DNA nucleotide, and where the PAM is immediately 3' of the guide RNA target sequence on the non-complementary strand of the target DNA. As such, the sequence corresponding to the PAM on the complementary strand (i.e., the reverse complement) would be 5'-CC$N_2$-3', where $N_2$ is any DNA nucleotide and is immediately 5' of the sequence to which the DNA-targeting segment of the guide RNA hybridizes on the complementary strand of the target DNA. In some such cases, $N_1$ and $N_2$ can be complementary and the $N_1$-$N_2$ base pair can be any base pair (e.g., $N_1$=C and $N_2$=G; $N_1$=G and $N_2$=C; $N_1$=A and $N_2$=T; or $N_1$=T, and $N_2$=A). In the case of Cas9 from S. aureus, the PAM can be NNGRRT or NNGRR, where N can A, G, C, or T, and R can be G or A. In the case of Cas9 from *C. jejuni*, the PAM can be, for example, NNNNACAC or NNNNRYAC, where N can be A, G, C, or T, and R can be G or A. In some cases (e.g., for FnCpf1), the PAM sequence can be upstream of the 5' end and have the sequence 5'-TTN-3'.

An example of a guide RNA target sequence is a 20-nucleotide DNA sequence immediately preceding an NGG motif recognized by an SpCas9 protein. For example, two examples of guide RNA target sequences plus PAMs are $GN_{19}NGG$ (SEQ ID NO: 40) or $N_{20}NGG$ (SEQ ID NO: 41). See, e.g., WO 2014/165825, herein incorporated by reference in its entirety for all purposes. The guanine at the 5' end can facilitate transcription by RNA polymerase in cells. Other examples of guide RNA target sequences plus PAMs can include two guanine nucleotides at the 5' end (e.g., $GGN_{20}NGG$; SEQ ID NO: 42) to facilitate efficient transcription by T7 polymerase in vitro. See, e.g., WO 2014/065596, herein incorporated by reference in its entirety for all purposes. Other guide RNA target sequences plus PAMs can have between 4-22 nucleotides in length of SEQ ID NOS: 40-42, including the 5' G or GG and the 3' GG or NGG. Yet other guide RNA target sequences plus PAMs can have between 14 and 20 nucleotides in length of SEQ ID NOS: 40-42.

Guide RNAs targeting an RS1 gene can target, for example, the first intron of the RS1 gene, or a sequence adjacent to the first intron of the RS1 gene (e.g., in the first exon or the second exon of the RS1 gene.

Formation of a CRISPR complex hybridized to a target DNA can result in cleavage of one or both strands of the target DNA within or near the region corresponding to the guide RNA target sequence (i.e., the guide RNA target sequence on the non-complementary strand of the target DNA and the reverse complement on the complementary strand to which the guide RNA hybridizes). For example, the cleavage site can be within the guide RNA target sequence (e.g., at a defined location relative to the PAM sequence). The "cleavage site" includes the position of a target DNA at which a Cas protein produces a single-strand break or a double-strand break. The cleavage site can be on only one strand (e.g., when a nickase is used) or on both strands of a double-stranded DNA. Cleavage sites can be at the same position on both strands (producing blunt ends; e.g. Cas9)) or can be at different sites on each strand (producing staggered ends (i.e., overhangs); e.g.; Cpf1). Staggered ends can be produced, for example, by using two Cas proteins, each of which produces a single-strand break at a different cleavage site on a different strand, thereby producing a double-strand break. For example, a first nickase can create a single-strand break on the first strand of double-stranded DNA (dsDNA), and a second nickase can create a single-strand break on the second strand of dsDNA such that overhanging sequences are created. In some cases, the guide RNA target sequence or cleavage site of the nickase on the first strand is separated from the guide RNA target sequence or cleavage site of the nickase on the second strand by at least 2, 3, 4, 5, 6, 7, 8, 9, 10, 15, 20, 25, 30, 40, 50, 75, 100, 250, 500, or 1,000 base pairs.

A guide RNA targeting an RS1 gene, such as a human RS1 gene, can target any desired location in the RS1 gene. Guide RNAs targeting an RS1 gene can target, for example, the first intron of the RS1 gene, or a sequence adjacent to the first intron of the RS1 gene (e.g., in the first exon or the second exon of the RS1 gene. For example, a guide RNA target sequence can comprise any contiguous sequence in the RS1 gene. The term RS1 gene includes the genomic region encompassing the RS1 regulatory promoters and enhancer sequences as well as the coding sequence. A guide RNA target sequence can comprise a coding sequence, a non-coding sequence (e.g., a regulatory element such as a promoter or enhancer region), or a combination thereof. As one example, a guide RNA target sequence can comprise a contiguous coding sequence in any of the RS1 coding exons. As one example, the guide RNA target sequence can be in exon 1 of the RS1 gene. As another example, the guide RNA target sequence can be in exon 2 of the RS1 gene. As another example, the guide RNA target sequence can be in exon 3 of the RS1 gene. As another example, the guide RNA target sequence can be in exon 4 of the RS1 gene. As another example, the guide RNA target sequence can be in exon 5 of the RS1 gene. As another example, the guide RNA target sequence can be in exon 6 of the RS1 gene. A guide RNA target sequence can also comprise a contiguous sequence in any of the RS1 introns. As one example, the guide RNA target sequence can be in intron 1 of the RS1 gene. As another example, the guide RNA target sequence can be in intron 2 of the RS1 gene. As another example, the guide RNA target sequence can be in intron 3 of the RS1 gene. As another example, the guide RNA target sequence can be in intron 4 of the RS1 gene. As another example, the guide RNA target sequence can be in intron 5 of the RS1 gene. As another example, the guide RNA target sequence can be in intron 6 of the RS1 gene.

The guide RNA target sequence can also be selected to minimize off-target modification or avoid off-target effects (e.g., by avoiding two or fewer mismatches to off-target genomic sequences).

As one example, a guide RNA targeting an RS1 gene can target the guide RNA target sequence set forth in any one of SEQ ID NOS: 54-3147. As another example, a guide RNA targeting an RS1 gene can target at least 17, at least 18, at least 19, or at least 20 contiguous nucleotides of the guide RNA target sequence set forth in any one of SEQ ID NOS: 54-3147. Examples of such guide RNA target sequences are set forth in Tables 2 and 3.

As one example, a guide RNA targeting a human RS1 gene can target the guide RNA target sequence set forth in any one of SEQ ID NOS: 54-1895. As another example, a guide RNA targeting a human RS1 gene can target at least 17, at least 18, at least 19, or at least 20 contiguous nucleotides of the guide RNA target sequence set forth in any one of SEQ ID NOS: 54-1895.

As one example, a guide RNA targeting a human RS1 gene can target the guide RNA target sequence set forth in any one of SEQ ID NOS: 54-57, 60-92, 94-153, and 155-1257. As another example, a guide RNA targeting a human RS1 gene can target at least 17, at least 18, at least 19, or at least 20 contiguous nucleotides of the guide RNA target sequence set forth in any one of SEQ ID NOS: 54-57, 60-92, 94-153, and 155-1257.

As one example, a guide RNA targeting a human RS1 gene can target the guide RNA target sequence set forth in any one of SEQ TD NOS: 56, 57, 65, 581, 1203, and 1210. As another example, a guide RNA targeting a human RS1 gene can target at least 17, at least 18, at least 19, or at least 20 contiguous nucleotides of the guide RNA target sequence set forth in any one of SEQ ID NOS: 56, 57, 65, 581, 1203, and 1210.

As one example, a guide RNA targeting a mouse Psi gene can target the guide RNA target sequence set forth in any one of SEQ TD NOS: 1896-3147 (e.g., SEQ ID NO: 2383 or 2887). As another example, a guide RNA targeting a mouse Rs1 gene can target at least 17, at least 18, at least 19, or at least 20 contiguous nucleotides of the guide RNA target sequence set forth in any one of SEQ ID NOS: 1896-3147 (e.g., SEQ ID NO: 2383 or 2887).

TABLE 2

Human RS1 Intron 1 Guide RNA Target Sequences and Guide Sequences.

| Target | SEQ ID NO. | PAM | Direction | Guide | SEQ ID NO. |
| --- | --- | --- | --- | --- | --- |
| GGGCCTTATGCATCTCCATC | 54 | TGG | - | GGGCCUUAUGCAUCUCCAUC | 3148 |
| TAATCAGCATATTATCCAGA | 55 | TGG | + | UAAUCAGCAUAUUAUCCAGA | 3149 |
| CCCTTTTGTACGTTTTTAA | 56 | TGG | + | CCCUUUUGUACGUUUUUAA | 3150 |
| CTGTATCTTCTTAGCCAGTA | 57 | CGG | + | CUGUAUCUUCUUAGCCAGUA | 3151 |
| GTTAACGCGTCATTTACATT | 58 | AGG | - | GUUAACGCGUCAUUUACAUU | 3152 |
| TACAATAAATTAGCCGGATG | 59 | TGG | - | UACAAUAAAUUAGCCGGAUG | 3153 |
| AAACTTTTAGGAGTCAAAGT | 60 | GGG | + | AAACUUUUAGGAGUCAAAGU | 3154 |
| AAAACTTTTAGGAGTCAAAG | 61 | TGG | + | AAAACUUUUAGGAGUCAAAG | 3155 |
| AATGTTAACAGTGTTGGCTT | 62 | TGG | + | AAUGUUAACAGUGUUGGCUU | 3156 |
| GTGGTGGCTGCAGGTGAGGG | 63 | TGG | + | GUGGUGGCUGCAGGUGAGGG | 3157 |
| TACTAAAATGTTAACAGTGT | 64 | TGG | + | UACUAAAAUGUUAACAGUGU | 3158 |
| AAAAAAGGACTTGACATGCA | 65 | GGG | + | AAAAAAGGACUUGACAUGCA | 3159 |
| GTCCCAGCTTCTCTTGAGGG | 66 | TGG | + | GUCCCAGCUUCUCUUGAGGG | 3160 |
| GTTAACAGTGTTGGCTTTGG | 67 | TGG | + | GUUAACAGUGUUGGCUUUGG | 3161 |
| GTTGGTGGTCACTGACAGTG | 68 | TGG | - | GUUGGUGGUCACUGACAGUG | 3162 |
| GAAACTAGTGGCTACCGTAC | 69 | TGG | - | GAAACUAGUGGCUACCGUAC | 3163 |
| AAAAAACGTACAAAAGGGGC | 70 | CGG | - | AAAAAACGUACAAAAGGGGC | 3164 |
| AGCCCCAGGCCATCAACCGG | 71 | CGG | + | AGCCCCAGGCCAUCAACCGG | 3165 |
| GGCAGCCAGACAGATGCTTC | 72 | TGG | - | GGCAGCCAGACAGAUGCUUC | 3166 |
| CTGGAGAACAAAAGCATTTT | 73 | TGG | - | CUGGAGAACAAAAGCAUUUU | 3167 |
| ATCTTAGATTTATGCAATGT | 74 | GGG | - | AUCUUAGAUUUAUGCAAUGU | 3168 |
| ACAAGTAGAATCAGAATTCT | 75 | TGG | + | ACAAGUAGAAUCAGAAUUCU | 3169 |
| AATATCGGCTCACTGCAACC | 76 | CGG | + | AAUAUCGGCUCACUGCAACC | 3170 |
| CCCTCAAGAGAAGCTGGGAC | 77 | TGG | - | CCCUCAAGAGAAGCUGGGAC | 3171 |
| TCTTAGGAGATGACGAGGTT | 78 | GGG | - | UCUUAGGAGAUGACGAGGUU | 3172 |
| AATAATAAAGAACTAGAGAA | 79 | AGG | + | AAUAAUAAAGAACUAGAGAA | 3173 |
| AAAAACGTACAAAAGGGGCC | 80 | GGG | - | AAAAACGUACAAAAGGGGCC | 3174 |
| GGCTGAGCAGGCGGAGAAGT | 81 | AGG | + | GGCUGAGCAGGCGGAGAAGU | 3175 |
| AGAGAAGGAGAACAGTCTG | 82 | AGG | + | AGAGAAGGAGAACAGUCUG | 3176 |
| CTTCTTTCTCTTTCACGAGA | 83 | GGG | + | CUUCUUUCUCUUUCACGAGA | 3177 |
| AATCTTAGATTTATGCAATG | 84 | TGG | - | AAUCUUAGAUUUAUGCAAUG | 3178 |
| CTGAGCAGGCGGAGAAGTAG | 85 | GGG | + | CUGAGCAGGCGGAGAAGUAG | 3179 |
| ACCTAGTGTTGACAAGGCTG | 86 | TGG | - | ACCUAGUGUUGACAAGGCUG | 3180 |
| TCCCAGCTTCTCTTGAGGGT | 87 | GGG | + | UCCCAGCUUCUCUUGAGGGU | 3181 |
| AATAATTCTGTTGGGACGAC | 88 | AGG | + | AAUAAUUCUGUUGGGACGAC | 3182 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CCTATAAAGAGGACGTTTCC | 89 | TGG | - | CCUAUAAAGAGGACGUUUCC | 3183 |
| CCTTCTTTCTCTTTCACGAG | 90 | AGG | + | CCUUCUUUCUCUUUCACGAG | 3184 |
| CCCATCGAAGTACTCACCAT | 91 | GGG | + | CCCAUCGAAGUACUCACCAU | 3185 |
| GTGTCATATGTTGCTGGTGG | 92 | GGG | - | GUGUCAUAUGUUGCUGGUGG | 3186 |
| AATGTAAATGACGCGTTAAC | 93 | AGG | + | AAUGUAAAUGACGCGUUAAC | 3187 |
| GCCTTTGAGCCAAGTGGATT | 94 | TGG | + | GCCUUUGAGCCAAGUGGAUU | 3188 |
| GTCAGACTCTGTGCTGGCTG | 95 | AGG | - | GUCAGACUCUGUGCUGGCUG | 3189 |
| CCGTCAATAGCATTCCGGTT | 96 | TGG | - | CCGUCAAUAGCAUUCCGGUU | 3190 |
| CCATTAAAAACGTACAAAA | 97 | GGG | - | CCAUUAAAAACGUACAAAA | 3191 |
| GGGATTTGGGGAGGATGGGG | 98 | AGG | - | GGGAUUUGGGGAGGAUGGGG | 3192 |
| ACTGTGTCATATGTTGCTGG | 99 | TGG | - | ACUGUGUCAUAUGUUGCUGG | 3193 |
| TACAATGTTGTGGACCGGGC | 100 | TGG | - | UACAAUGUUGUGGACCGGGC | 3194 |
| GATAGAGTAGCAAACAAAAC | 101 | AGG | - | GAUAGAGUAGCAAACAAAAC | 3195 |
| GCTCTCAAAGGAGACTGAGA | 102 | AGG | + | GCUCUCAAAGGAGACUGAGA | 3196 |
| GGAAGAGCAAGGAGCTCCTG | 103 | AGG | - | GGAAGAGCAAGGAGCUCCUG | 3197 |
| TGTGTCATATGTTGCTGGTG | 104 | GGG | - | UGUGUCAUAUGUUGCUGGUG | 3198 |
| CTGAGAAGGTGTACCTAGAG | 105 | TGG | + | CUGAGAAGGUGUACCUAGAG | 3199 |
| GTCCGGGAGCCAGTTCCTGC | 106 | AGG | - | GUCCGGGAGCCAGUUCCUGC | 3200 |
| TTAGGAGATGACGAGGTTGG | 107 | GGG | - | UUAGGAGAUGACGAGGUUGG | 3201 |
| GGAGGAAGCAGAGCTCTCAA | 108 | AGG | + | GGAGGAAGCAGAGCUCUCAA | 3202 |
| AGTCATCAGCCTGGGAAACA | 109 | TGG | - | AGUCAUCAGCCUGGGAAACA | 3203 |
| TCCGGGAGCCAGTTCCTGCA | 110 | GGG | - | UCCGGGAGCCAGUUCCUGCA | 3204 |
| GAGCAAGGAGCTCCTGAGGC | 111 | TGG | - | GAGCAAGGAGCUCCUGAGGC | 3205 |
| TCTGGTACAATGTTGTGGAC | 112 | CGG | - | UCUGGUACAAUGUUGUGGAC | 3206 |
| CCTGGGAGTGTCTGACAACC | 113 | AGG | - | CCUGGGAGUGUCUGACAACC | 3207 |
| CCAGTTCCTGCAGGGCCTCG | 114 | TGG | - | CCAGUUCCUGCAGGGCCUCG | 3208 |
| TAGGGAATGGGCTGAGCAGG | 115 | CGG | + | UAGGGAAUGGGCUGAGCAGG | 3209 |
| AGCTTTCTGTCCCTGTGAGA | 116 | AGG | + | AGCUUUCUGUCCCUGUGAGA | 3210 |
| TCGTCTCCCTGCCTTCTCAC | 117 | AGG | - | UCGUCUCCCUGCCUUCUCAC | 3211 |
| CGAAGTACTCACCATGGGCA | 118 | TGG | + | CGAAGUACUCACCAUGGGCA | 3212 |
| AGGCCACTGGACCATGCCCA | 119 | TGG | - | AGGCCACUGGACCAUGCCCA | 3213 |
| GGCAGGGAGACGAGTCTAAT | 120 | GGG | + | GGCAGGGAGACGAGUCUAAU | 3214 |
| GGGCTTAGATTTATGCAATA | 121 | TGG | - | GGGCUUAGAUUUAUGCAAUA | 3215 |
| TTCAGCGAAGACAAGGGATT | 122 | TGG | - | UUCAGCGAAGACAAGGGAUU | 3216 |
| CATGGCCCACGAGGCCCTGC | 123 | AGG | + | CAUGGCCCACGAGGCCCUGC | 3217 |
| CAGTTCCTGCAGGGCCTCGT | 124 | GGG | - | CAGUUCCUGCAGGGCCUCGU | 3218 |
| CATTAAAAACGTACAAAAG | 125 | GGG | - | CAUUAAAAACGUACAAAAG | 3219 |
| AGGCAGGGAGACGAGTCTAA | 126 | TGG | + | AGGCAGGGAGACGAGUCUAA | 3220 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CTAACATCTGGATGAACCTG | 127 | AGG | - | CUAACAUCUGGAUGAACCUG | 3221 |
| CCAGTGGCCTGTCTTCTCCT | 128 | GGG | + | CCAGUGGCCUGUCUUCUCCU | 3222 |
| TATTACAAATACTGCCGCTA | 129 | TGG | + | UAUUACAAAUACUGCCGCUA | 3223 |
| GCAGGGAGACGAGTCTAATG | 130 | GGG | + | GCAGGGAGACGAGUCUAAUG | 3224 |
| CAATCTGCTTGAGAAACAGG | 131 | AGG | - | CAAUCUGCUUGAGAAACAGG | 3225 |
| GGCTTAGATTTATGCAATAT | 132 | GGG | - | GGCUUAGAUUUAUGCAAUAU | 3226 |
| ACACTCCCAGGGCTCACTCT | 133 | CGG | + | ACACUCCCAGGGCUCACUCU | 3227 |
| TATGGGCTCATTCTGCCCCT | 134 | TGG | - | UAUGGGCUCAUUCUGCCCCU | 3228 |
| CGAAGACAAGGGATTTGGGG | 135 | AGG | - | CGAAGACAAGGGAUUUGGGG | 3229 |
| AGCACAGAGTCTGACATTGA | 136 | GGG | + | AGCACAGAGUCUGACAUUGA | 3230 |
| GTCTTAGGAGATGACGAGGT | 137 | TGG | - | GUCUUAGGAGAUGACGAGGU | 3231 |
| GCTGAGCAGGCGGAGAAGTA | 138 | GGG | + | GCUGAGCAGGCGGAGAAGUA | 3232 |
| TTCCAATCTGCTTGAGAAAC | 139 | AGG | - | UUCCAAUCUGCUUGAGAAAC | 3233 |
| GAGATCATAATACATCTCAG | 140 | AGG | + | GAGAUCAUAAUACAUCUCAG | 3234 |
| GCCCATCGAAGTACTCACCA | 141 | TGG | + | GCCCAUCGAAGUACUCACCA | 3235 |
| CAGGCGGAGAAGTAGGGGTG | 142 | GGG | + | CAGGCGGAGAAGUAGGGGUG | 3236 |
| TTGAAACCCAGTCACCAATG | 143 | TGG | - | UUGAAACCCAGUCACCAAUG | 3237 |
| ACATAATCCAACTGAGAGTC | 144 | AGG | + | ACAUAAUCCAACUGAGAGUC | 3238 |
| GTGAGTGTACTGAGTCTCCG | 145 | AGG | - | GUGAGUGUACUGAGUCUCCG | 3239 |
| CAATGGAGTCACACAGCATG | 146 | TGG | + | CAAUGGAGUCACACAGCAUG | 3240 |
| GGGGTGGGGGGACGCATTTG | 147 | AGG | + | GGGGUGGGGGGACGCAUUUG | 3241 |
| AACTGAGAGTCAGGAAACCT | 148 | CGG | + | AACUGAGAGUCAGGAAACCU | 3242 |
| TGCTCACTTCCATAAGGATA | 149 | TGG | + | UGCUCACUUCCAUAAGGAUA | 3243 |
| ATTTGGGGAGGATGGGGAGG | 150 | AGG | - | AUUUGGGGAGGAUGGGGAGG | 3244 |
| CGGGCTGGCCACGGCAAGTG | 151 | TGG | - | CGGGCUGGCCACGGCAAGUG | 3245 |
| CTCAATGTCAGACTCTGTGC | 152 | TGG | - | CUCAAUGUCAGACUCUGUGC | 3246 |
| TGCAGACTATTAATTGCAAG | 153 | GGG | - | UGCAGACUAUUAAUUGCAAG | 3247 |
| ACAGGCGTGAGCCACGGGCC | 154 | TGG | + | ACAGGCGUGAGCCACGGGCC | 3248 |
| CATCAATTGTGCCAGGCCCG | 155 | TGG | - | CAUCAAUUGUGCCAGGCCCG | 3249 |
| CAGCACAGAGTCTGACATTG | 156 | AGG | + | CAGCACAGAGUCUGACAUUG | 3250 |
| GTTGCAGACTATTAATTGCA | 157 | AGG | - | GUUGCAGACUAUUAAUUGCA | 3251 |
| GCAAGTGTGGCAACAGGGTC | 158 | CGG | - | GCAAGUGUGGCAACAGGGUC | 3252 |
| TAGGGTCTTGGAGTTTTGAT | 159 | AGG | - | UAGGGUCUUGGAGUUUUGAU | 3253 |
| AAAGCCTCACATGGCCCACG | 160 | AGG | + | AAAGCCUCACAUGGCCCACG | 3254 |
| CCTCGAGGTGAGCGTGTGCT | 161 | TGG | - | CCUCGAGGUGAGCGUGUGCU | 3255 |
| GCAGGCGGAGAAGTAGGGGT | 162 | GGG | + | GCAGGCGGAGAAGUAGGGGU | 3256 |
| CATTTTTGTGGACAGTTGTG | 163 | TGG | + | CAUUUUUGUGGACAGUUGUG | 3257 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TTGCAGACTATTAATTGCAA | 164 | GGG | - | UUGCAGACUAUUAAUUGCAA | 3258 |
| CTGGTTGTCAGACACTCCCA | 165 | GGG | + | CUGGUUGUCAGACACUCCCA | 3259 |
| CAGCGAAGACAAGGGATTTG | 166 | GGG | - | CAGCGAAGACAAGGGAUUUG | 3260 |
| TCAGCGAAGACAAGGGATTT | 167 | GGG | - | UCAGCGAAGACAAGGGAUUU | 3261 |
| TGGATTTGAAAATAAGAAGT | 168 | TGG | + | UGGAUUUGAAAAUAAGAAGU | 3262 |
| AGGTTTAAAAATATTGGGTG | 169 | TGG | + | AGGUUUAAAAAUAUUGGGUG | 3263 |
| TTGGCCCAGGGTGGTGGCAG | 170 | TGG | - | UUGGCCCAGGGUGGUGGCAG | 3264 |
| ACAGAAAAGCTGTCACCAA | 171 | AGG | - | ACAGAAAAGCUGUCACCAA | 3265 |
| ACAAGGGATTTGGGGAGGAT | 172 | GGG | - | ACAAGGGAUUUGGGGAGGAU | 3266 |
| GGCAGCCCCAGGCCATCAAC | 173 | CGG | + | GGCAGCCCCAGGCCAUCAAC | 3267 |
| CAGGTTCCCAGCTGTACAAT | 174 | GGG | - | CAGGUUCCCAGCUGUACAAU | 3268 |
| AGGCGGAGAAGTAGGGGTGG | 175 | GGG | + | AGGCGGAGAAGUAGGGGUGG | 3269 |
| AGTGTGGTGGCTGCAGGTGA | 176 | GGG | + | AGUGUGGUGGCUGCAGGUGA | 3270 |
| AGCACATTGGGCAGACACAA | 177 | GGG | + | AGCACAUUGGGCAGACACAA | 3271 |
| CCACGAGGCCCTGCAGGAAC | 178 | TGG | + | CCACGAGGCCCUGCAGGAAC | 3272 |
| CGTCTCCCTGCCTTCTCACA | 179 | GGG | - | CGUCUCCCUGCCUUCUCACA | 3273 |
| AGATACTAATCCCATGTATG | 180 | AGG | + | AGAUACUAAUCCCAUGUAUG | 3274 |
| TTAGGCTTTGCCCTCATACA | 181 | TGG | - | UUAGGCUUUGCCCUCAUACA | 3275 |
| CTACTCGGGGAGGCTGAAG | 182 | CGG | + | CUACUCGGGGAGGCUGAAG | 3276 |
| ACCTCACTGCCTCAGCAGCG | 183 | TGG | + | ACCUCACUGCCUCAGCAGCG | 3277 |
| TTGAGGACCCAGGAGAAGAC | 184 | AGG | - | UUGAGGACCCAGGAGAAGAC | 3278 |
| CTTAGGAGATGACGAGGTTG | 185 | GGG | - | CUUAGGAGAUGACGAGGUUG | 3279 |
| GGCGGAGAAGTAGGGGTGGG | 186 | GGG | + | GGCGGAGAAGUAGGGGUGGG | 3280 |
| CTGGTACAATGTTGTGGACC | 187 | GGG | - | CUGGUACAAUGUUGUGGACC | 3281 |
| GGCAAAGCATTCTGGGCAGA | 188 | GGG | - | GGCAAAGCAUUCUGGGCAGA | 3282 |
| GAAAATTACGGTGACTGCTG | 189 | TGG | - | GAAAAUUACGGUGACUGCUG | 3283 |
| GGACCAACCTAGTGTTGACA | 190 | AGG | - | GGACCAACCUAGUGUUGACA | 3284 |
| GCTTTTGTTCTCCAGTTTGT | 191 | TGG | + | GCUUUUGUUCUCCAGUUUGU | 3285 |
| TGATTTAATCACCAACAAAC | 192 | TGG | - | UGAUUUAAUCACCAACAAAC | 3286 |
| ATTTAGCAATGTTTACTGGG | 193 | TGG | + | AUUUAGCAAUGUUUACUGGG | 3287 |
| GGCATTGAATCCAATATGTG | 194 | CGG | - | GGCAUUGAAUCCAAUAUGUG | 3288 |
| GTGTTACCATCAGAGATTGC | 195 | AGG | + | GUGUUACCAUCAGAGAUUGC | 3289 |
| GTAGGCCATTCAGTGCTTAC | 196 | TGG | + | GUAGGCCAUUCAGUGCUUAC | 3290 |
| TTTGAAAATAAGAAGTTGGC | 197 | TGG | + | UUUGAAAAUAAGAAGUUGGC | 3291 |
| CACCTCGTTCCGCCGGTTGA | 198 | TGG | - | CACCUCGUUCCGCCGGUUGA | 3292 |
| ACACGCTCACCTCGAGGGCT | 199 | TGG | + | ACACGCUCACCUCGAGGGCU | 3293 |
| GATATCCAGTAAGCACTGAA | 200 | TGG | - | GAUAUCCAGUAAGCACUGAA | 3294 |
| TGGATTTAGCAATGTTTACT | 201 | GGG | + | UGGAUUUAGCAAUGUUUACU | 3295 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TAAAGAGGACGTTTCCTGGC | 202 | CGG | - | UAAAGAGGACGUUUCCUGGC | 3296 |
| TTAATCTGTCTTTTGTCGTA | 203 | GGG | - | UUAAUCUGUCUUUUGUCGUA | 3297 |
| ATAGGAAATGCCTTACTGTG | 204 | AGG | - | AUAGGAAAUGCCUUACUGUG | 3298 |
| CTTACTGGATATCTGAACCT | 205 | TGG | + | CUUACUGGAUAUCUGAACCU | 3299 |
| AGTAAACATTGCTAAATCCA | 206 | AGG | - | AGUAAACAUUGCUAAAUCCA | 3300 |
| GGGTTCTTGCCTTGGGGTAT | 207 | CGG | - | GGGUUCUUGCCUUGGGGUAU | 3301 |
| GTGAGGCTTTGTGGAACTTG | 208 | AGG | - | GUGAGGCUUUGUGGAACUUG | 3302 |
| ACATCTTACTACTACCACAT | 209 | TGG | + | ACAUCUUACUACUACCACAU | 3303 |
| CCACCAACACCCCTTGCCTT | 210 | TGG | + | CCACCAACACCCCUUGCCUU | 3304 |
| TTTTTGGGAGACCAAAGGCA | 211 | AGG | - | UUUUUGGGAGACCAAAGGCA | 3305 |
| TTTCATCCTCCACGCTGCTG | 212 | AGG | - | UUUCAUCCUCCACGCUGCUG | 3306 |
| TCAGAGCCACATGAAACTAG | 213 | TGG | - | UCAGAGCCACAUGAAACUAG | 3307 |
| TCCATTAAAAAACGTACAAA | 214 | AGG | - | UCCAUUAAAAAACGUACAAA | 3308 |
| AAAAAAGGACTTGACATGC | 215 | AGG | + | AAAAAAGGACUUGACAUGC | 3309 |
| GCTCCTGAGGCTGGAGCTAG | 216 | AGG | - | GCUCCUGAGGCUGGAGCUAG | 3310 |
| AGAAGGTGTACCTAGAGTGG | 217 | TGG | + | AGAAGGUGUACCUAGAGUGG | 3311 |
| GGTGCCAGCAGATTTGGGTC | 218 | TGG | + | GGUGCCAGCAGAUUUGGGUC | 3312 |
| GATACTAATCCCATGTATGA | 219 | GGG | + | GAUACUAAUCCCAUGUAUGA | 3313 |
| GAAATCCGAGAGTGAGCCCT | 220 | GGG | - | GAAAUCCGAGAGUGAGCCCU | 3314 |
| AAAACCCTGCAATCTCTGA | 221 | TGG | - | AAAACCCUGCAAUCUCUGA | 3315 |
| TAATAATATTTATATTATTC | 222 | AGG | - | UAAUAAUAUUUAUAUUAUUC | 3316 |
| AGAAAAGAAATGCAAGAAAT | 223 | GGG | + | AGAAAAGAAAUGCAAGAAAU | 3317 |
| TGAACTGTGTCATATGTTGC | 224 | TGG | - | UGAACUGUGUCAUAUGUUGC | 3318 |
| CAGAAAGCTTTCTGTATCTC | 225 | AGG | - | CAGAAAGCUUUCUGUAUCUC | 3319 |
| AGAAGCTGGGACTGGCTGTG | 226 | AGG | - | AGAAGCUGGGACUGGCUGUG | 3320 |
| CTTCTCTTGAGGGTGGGGAT | 227 | GGG | + | CUUCUCUUGAGGGUGGGGAU | 3321 |
| GCCCAGAATGCTTTGCCCAC | 228 | AGG | + | GCCCAGAAUGCUUUGCCCAC | 3322 |
| AGCAGGCGGAGAAGTAGGGG | 229 | TGG | + | AGCAGGCGGAGAAGUAGGGG | 3323 |
| TCTCCTCTAGCTCCAGCCTC | 230 | AGG | + | UCUCCUCUAGCUCCAGCCUC | 3324 |
| GGTTAAATGAAAGGGAAAGC | 231 | AGG | + | GGUUAAAUGAAAGGGAAAGC | 3325 |
| CTAAAGCGCGCCTTTCCTCA | 232 | TGG | + | CUAAAGCGCGCCUUUCCUCA | 3326 |
| AGAAGATGCTGGCTTGGCCC | 233 | AGG | - | AGAAGAUGCUGGCUUGGCCC | 3327 |
| CAGGAGCTCCTTGCTCTTCC | 234 | TGG | + | CAGGAGCUCCUUGCUCUUCC | 3328 |
| CTGTGTCATATGTTGCTGGT | 235 | GGG | - | CUGUGUCAUAUGUUGCUGGU | 3329 |
| TAGCACATTGGGCAGACACA | 236 | AGG | + | UAGCACAUUGGGCAGACACA | 3330 |
| GAAGCATATCACTTCTGCTA | 237 | GGG | - | GAAGCAUAUCACUUCUGCUA | 3331 |
| GTTGTGGACCGGGCTGGCCA | 238 | CGG | - | GUUGUGGACCGGGCUGGCCA | 3332 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TCCAGTGGCCTGTCTTCTCC | 239 | TGG | + | UCCAGUGGCCUGUCUUCUCC | 3333 |
| AATTTCCTGCTGTGACAACA | 240 | AGG | + | AAUUUCCUGCUGUGACAACA | 3334 |
| CAAGGGATTTGGGGAGGATG | 241 | GGG | - | CAAGGGAUUUGGGGAGGAUG | 3335 |
| AGGAAGTAGGGAACAGGGAC | 242 | TGG | - | AGGAAGUAGGGAACAGGGAC | 3336 |
| ACCTCCATCTCTATAAAAAT | 243 | AGG | + | ACCUCCAUCUCUAUAAAAAU | 3337 |
| TTACTTCTCTTTGGCTATGA | 244 | AGG | + | UUACUUCUCUUUGGCUAUGA | 3338 |
| TCCCACTGGCCCACGTTGCA | 245 | GGG | - | UCCCACUGGCCCACGUUGCA | 3339 |
| CAGCCATGTTGCTTCTCCTT | 246 | TGG | + | CAGCCAUGUUGCUUCUCCUU | 3340 |
| TATTTTTCTCCCTGTTTAGA | 247 | TGG | - | UAUUUUUCUCCCUGUUUAGA | 3341 |
| GGGCAAAGCATTCTGGGCAG | 248 | AGG | - | GGGCAAAGCAUUCUGGGCAG | 3342 |
| GAAGGAGGCGAGACACCTGT | 249 | GGG | - | GAAGGAGGCGAGACACCUGU | 3343 |
| ATTTCCTGCTGTGACAACAA | 250 | GGG | + | AUUUCCUGCUGUGACAACAA | 3344 |
| AAGAAAAGAAATGCAAGAAA | 251 | TGG | + | AAGAAAAGAAAUGCAAGAAA | 3345 |
| GCTTCTCTTGAGGGTGGGGA | 252 | TGG | + | GCUUCUCUUGAGGGUGGGGA | 3346 |
| ATTAATCTGTCTTTTGTCGT | 253 | AGG | - | AUUAAUCUGUCUUUUGUCGU | 3347 |
| ACAGGAGGAACGCACGCAGC | 254 | AGG | - | ACAGGAGGAACGCACGCAGC | 3348 |
| CCTGGTTGTCAGACACTCCC | 255 | AGG | + | CCUGGUUGUCAGACACUCCC | 3349 |
| AGGTCAACATCAATTGTGCC | 256 | AGG | - | AGGUCAACAUCAAUUGUGCC | 3350 |
| GACAAGGGATTTGGGGAGGA | 257 | TGG | - | GACAAGGGAUUUGGGGAGGA | 3351 |
| GGCTTAGATCTAAATACTCC | 258 | TGG | + | GGCUUAGAUCUAAAUACUCC | 3352 |
| GAGCACACAGCCTCACAGTA | 259 | AGG | + | GAGCACACAGCCUCACAGUA | 3353 |
| GTTACCATCAGAGATTGCAG | 260 | GGG | + | GUUACCAUCAGAGAUUGCAG | 3354 |
| TTGGATTTAGCAATGTTTAC | 261 | TGG | + | UUGGAUUUAGCAAUGUUUAC | 3355 |
| CTTGGAGTTTTGATAGGCAC | 262 | AGG | - | CUUGGAGUUUUGAUAGGCAC | 3356 |
| ATTTAATAAAAGAGAAACCT | 263 | TGG | + | AUUUAAUAAAAGAGAAACCU | 3357 |
| TTTAATAAAAGAGAAACCTT | 264 | GGG | + | UUUAAUAAAAGAGAAACCUU | 3358 |
| ATTAAAAGCAGGGAGAAGG | 265 | AGG | + | AUUAAAAGCAGGGAGAAGG | 3359 |
| GAGTTCCAGAAGCATCTGTC | 266 | TGG | + | GAGUUCCAGAAGCAUCUGUC | 3360 |
| GAAGATGCTGGCTTGGCCCA | 267 | GGG | - | GAAGAUGCUGGCUUGGCCCA | 3361 |
| GCTAGAGGAGAGAGAGTCTT | 268 | AGG | - | GCUAGAGGAGAGAGAGUCUU | 3362 |
| CGAAGGAGGCGAGACACCTG | 269 | TGG | - | CGAAGGAGGCGAGACACCUG | 3363 |
| GACAAACAGCCTTTGTCTTC | 270 | AGG | - | GACAAACAGCCUUUGUCUUC | 3364 |
| TATTGGATTCAATGCCAATA | 271 | AGG | + | UAUUGGAUUCAAUGCCAAUA | 3365 |
| TCCCCACCCTCAAGAGAAGC | 272 | TGG | - | UCCCCACCCUCAAGAGAAGC | 3366 |
| TCACAGCAGAGTGGCCCTTT | 273 | TGG | + | UCACAGCAGAGUGGCCCUUU | 3367 |
| GATTGAGAGGGAATTGGAAC | 274 | TGG | - | GAUUGAGAGGGAAUUGGAAC | 3368 |
| TTTTGGGAGACCAAAGGCAA | 275 | GGG | - | UUUUGGGAGACCAAAGGCAA | 3369 |
| CCCAGCTTCTCTTGAGGGTG | 276 | GGG | + | CCCAGCUUCUCUUGAGGGUG | 3370 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| GACTGCACTCACCTCGGAAC | 277 | CGG | + | GACUGCACUCACCUCGGAAC | 3371 |
| GGCAACAGGGTCCGGTTCCG | 278 | AGG | - | GGCAACAGGGUCCGGUUCCG | 3372 |
| TGACGAGGTTGGGGGTGTCC | 279 | GGG | - | UGACGAGGUUGGGGGUGUCC | 3373 |
| TAGGCTTTGCCCTCATACAT | 280 | GGG | - | UAGGCUUUGCCCUCAUACAU | 3374 |
| TGAAGCATATCACTTCTGCT | 281 | AGG | - | UGAAGCAUAUCACUUCUGCU | 3375 |
| AATCAGAATTCTTGGTTTCA | 282 | CGG | + | AAUCAGAAUUCUUGGUUUCA | 3376 |
| GATGTTCTAAAAATCCTTAT | 283 | TGG | - | GAUGUUCUAAAAAUCCUUAU | 3377 |
| AGACAAATGCTTTCTGCGGG | 284 | AGG | + | AGACAAAUGCUUUCUGCGGG | 3378 |
| TGTTACCATCAGAGATTGCA | 285 | GGG | + | UGUUACCAUCAGAGAUUGCA | 3379 |
| CCCGCCAAAGCGTTTTGCGC | 286 | AGG | + | CCCGCCAAAGCGUUUUGCGC | 3380 |
| CAGTTGTGTGGAAATATGAT | 287 | TGG | + | CAGUUGUGUGGAAAUAUGAU | 3381 |
| ACGATGTCCACAAAGAAGAC | 288 | AGG | - | ACGAUGUCCACAAAGAAGAC | 3382 |
| TTAGGCGACAGGCATATTCA | 289 | TGG | - | UUAGGCGACAGGCAUAUUCA | 3383 |
| GCTGGTTTAAAGCACTGATG | 290 | GGG | - | GCUGGUUUAAAGCACUGAUG | 3384 |
| CCAGGAAACGTCCTCTTTAT | 291 | AGG | + | CCAGGAAACGUCCUCUUUAU | 3385 |
| TCAGCCCATTCCCTATAAAG | 292 | AGG | - | UCAGCCCAUUCCCUAUAAAG | 3386 |
| AGAAAGCTTTCTGTATCTCA | 293 | GGG | - | AGAAAGCUUUCUGUAUCUCA | 3387 |
| ACTTATTAAATAAGTATGGA | 294 | TGG | - | ACUUAUUAAAUAAGUAUGGA | 3388 |
| ATTGGATTGCACCCAGGAAT | 295 | TGG | + | AUUGGAUUGCACCCAGGAAU | 3389 |
| TGCTTTCAGAGCCAATTCCT | 296 | GGG | - | UGCUUUCAGAGCCAAUUCCU | 3390 |
| TTCTGCCCCTTGGTCCAAAA | 297 | GGG | - | UUCUGCCCCUUGGUCCAAAA | 3391 |
| CAAATGGTGAGCTGAGGGAC | 298 | AGG | + | CAAAUGGUGAGCUGAGGGAC | 3392 |
| CCTTTAGCTTCCACCACTCT | 299 | AGG | - | CCUUUAGCUUCCACCACUCU | 3393 |
| AGGTCAACCTAGTTTAAATA | 300 | TGG | + | AGGUCAACCUAGUUUAAAUA | 3394 |
| TTGGTTGCCTGTCTTCTTTG | 301 | TGG | + | UUGGUUGCCUGUCUUCUUUG | 3395 |
| AGAAATCCGAGAGTGAGCCC | 302 | TGG | - | AGAAAUCCGAGAGUGAGCCC | 3396 |
| ACTGCAACCTTCCGCCCGCC | 303 | TGG | + | ACUGCAACCUUCCGCCCGCC | 3397 |
| ATCGATTGAACCCAGGCGGG | 304 | CGG | - | AUCGAUUGAACCCAGGCGGG | 3398 |
| TAGGCGACAGGCATATTCAT | 305 | GGG | - | UAGGCGACAGGCAUAUUCAU | 3399 |
| GGCGTGTTCCAGGAAGAGCA | 306 | AGG | - | GGCGUGUUCCAGGAAGAGCA | 3400 |
| CAAGCACACGCTCACCTCGA | 307 | GGG | + | CAAGCACACGCUCACCUCGA | 3401 |
| TTTATTATTATATGCATCAT | 308 | AGG | + | UUUAUUAUUAUAUGCAUCAU | 3402 |
| ATCTCAGGGTTCTTGCCTTG | 309 | GGG | - | AUCUCAGGGUUCUUGCCUUG | 3403 |
| CTTATTTAATAAGTTTTACA | 310 | TGG | + | CUUAUUUAAUAAGUUUUACA | 3404 |
| GGCAACCAATTTCTAACATC | 311 | TGG | - | GGCAACCAAUUUCUAACAUC | 3405 |
| AGAAGCAGTGGAGGGTAAAT | 312 | TGG | - | AGAAGCAGUGGAGGGUAAAU | 3406 |
| ATCACAGAAGCCATCTAAAC | 313 | AGG | + | AUCACAGAAGCCAUCUAAAC | 3407 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| GCTGGCTTGGCCCAGGGTGG | 314 | TGG | - | GCUGGCUUGGCCCAGGGUGG | 3408 |
| TTTAGCAATGTTTACTGGGT | 315 | GGG | + | UUUAGCAAUGUUUACUGGGU | 3409 |
| CTGTTTGTTCAGATTCGTGT | 316 | TGG | + | CUGUUUGUUCAGAUUCGUGU | 3410 |
| ACTGAGAAAACTGCAGAAGC | 317 | AGG | - | ACUGAGAAAACUGCAGAAGC | 3411 |
| TAAATTAATTAAAATTGGCC | 318 | GGG | - | UAAAUUAAUUAAAAUUGGCC | 3412 |
| TCTCCAGGTGCCCTGCAACG | 319 | TGG | + | UCUCCAGGUGCCCUGCAACG | 3413 |
| TTCCCACTGGCCCACGTTGC | 320 | AGG | - | UUCCCACUGGCCCACGUUGC | 3414 |
| TCGCTTAGCATATGTGGTTG | 321 | AGG | + | UCGCUUAGCAUAUGUGGUUG | 3415 |
| GATGCTTCTGGAACTCAAGG | 322 | GGG | - | GAUGCUUCUGGAACUCAAGG | 3416 |
| CAGCATGTGCCAAGCCCTCG | 323 | AGG | - | CAGCAUGUGCCAAGCCCUCG | 3417 |
| TCACAACAACTTCGGCCTCC | 324 | TGG | - | UCACAACAACUUCGGCCUCC | 3418 |
| ATCATCGCAGAAGGTTGCAT | 325 | TGG | - | AUCAUCGCAGAAGGUUGCAU | 3419 |
| GGCCTTTAACAGCACTTGAA | 326 | AGG | + | GGCCUUUAACAGCACUUGAA | 3420 |
| CGAGGCGGGCAAACCACTTG | 327 | AGG | - | CGAGGCGGGCAAACCACUUG | 3421 |
| TCTGAAGGGCCCTGTCAGTT | 328 | AGG | - | UCUGAAGGGCCCUGUCAGUU | 3422 |
| AGAAATATCTCAGCCTCTAA | 329 | AGG | - | AGAAAUAUCUCAGCCUCUAA | 3423 |
| GATGCTGGCTTGGCCCAGGG | 330 | TGG | - | GAUGCUGGCUUGGCCCAGGG | 3424 |
| CCACGGCAAGTGTGGCAACA | 331 | GGG | - | CCACGGCAAGUGUGGCAACA | 3425 |
| CCAAGCACACGCTCACCTCG | 332 | AGG | + | CCAAGCACACGCUCACCUCG | 3426 |
| CATCTTCACACCGCAATGTT | 333 | GGG | - | CAUCUUCACACCGCAAUGUU | 3427 |
| TTGTGTGGAAATATGATTGG | 334 | AGG | + | UUGUGUGGAAAUAUGAUUGG | 3428 |
| CTGCTTAGATTTTCTTGCTG | 335 | AGG | - | CUGCUUAGAUUUUCUUGCUG | 3429 |
| CTCCAGGTGCCCTGCAACGT | 336 | GGG | + | CUCCAGGUGCCCUGCAACGU | 3430 |
| GATGCATCCCATTGTACAGC | 337 | TGG | + | GAUGCAUCCCAUUGUACAGC | 3431 |
| GAAGGTTTCAGCGAAGACAA | 338 | GGG | - | GAAGGUUUCAGCGAAGACAA | 3432 |
| GTAGTGCCCACAGGATCTGC | 339 | GGG | - | GUAGUGCCCACAGGAUCUGC | 3433 |
| TCAGGTTCCCAGCTGTACAA | 340 | TGG | - | UCAGGUUCCCAGCUGUACAA | 3434 |
| TCCAAAATTGGATTGCACCC | 341 | AGG | + | UCCAAAAUUGGAUUGCACCC | 3435 |
| CTCCCTCTGGTACAATGTTG | 342 | TGG | - | CUCCCUCUGGUACAAUGUUG | 3436 |
| CACCTGTGGGCAAAGCATTC | 343 | TGG | - | CACCUGUGGGCAAAGCAUUC | 3437 |
| AGGACCATCCAGGGCAAATT | 344 | GGG | + | AGGACCAUCCAGGGCAAAUU | 3438 |
| AGTAACAAAAGTCATCAGCC | 345 | TGG | - | AGUAACAAAAGUCAUCAGCC | 3439 |
| CTGCAACCTTCCGCCCGCCT | 346 | GGG | + | CUGCAACCUUCCGCCCGCCU | 3440 |
| ACAGATGCTTCTGGAACTCA | 347 | AGG | - | ACAGAUGCUUCUGGAACUCA | 3441 |
| GGGCGGGCGGAAGGGGAAGA | 348 | AGG | - | GGGCGGGCGGAAGGGGAAGA | 3442 |
| CCCTGTTGCCACACTTGCCG | 349 | TGG | + | CCCUGUUGCCACACUUGCCG | 3443 |
| CGTTTCCTGGCCGGACGCAG | 350 | TGG | - | CGUUUCCUGGCCGGACGCAG | 3444 |
| CAGCCTTGTCAACACTAGGT | 351 | TGG | + | CAGCCUUGUCAACACUAGGU | 3445 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| GGACCATCCAGGGCAAATTG | 352 | GGG | + | GGACCAUCCAGGGCAAAUUG | 3446 |
| GTAACAAAAGTCATCAGCCT | 353 | GGG | - | GUAACAAAAGUCAUCAGCCU | 3447 |
| ATGCATCCATTGTACAGCT | 354 | GGG | + | AUGCAUCCAUUGUACAGCU | 3448 |
| TCTCGCTGTGTTGCTCAGGG | 355 | TGG | + | UCUCGCUGUGUUGCUCAGGG | 3449 |
| ACTGGGGAAGTAGTGCCCAC | 356 | AGG | - | ACUGGGGAAGUAGUGCCCAC | 3450 |
| GCTGAAGCAGATACACCACA | 357 | TGG | - | GCUGAAGCAGAUACACCACA | 3451 |
| ACTGACAGCACCCAACATTG | 358 | CGG | + | ACUGACAGCACCCAACAUUG | 3452 |
| CCATCTTCACACCGCAATGT | 359 | TGG | - | CCAUCUUCACACCGCAAUGU | 3453 |
| TACAGTGGACACAAAAAAAG | 360 | TGG | + | UACAGUGGACACAAAAAAAG | 3454 |
| GAGTCTCGCTGTGTTGCTCA | 361 | GGG | + | GAGUCUCGCUGUGUUGCUCA | 3455 |
| ATTACTGACCACAGTTTCAA | 362 | AGG | - | AUUACUGACCACAGUUUCAA | 3456 |
| ATGTGCTAGATGATCCATAG | 363 | CGG | - | AUGUGCUAGAUGAUCCAUAG | 3457 |
| TATCCAGATGGAGATGCATA | 364 | AGG | + | UAUCCAGAUGGAGAUGCAUA | 3458 |
| TCTGAGGTACCATATCCTTA | 365 | TGG | - | UCUGAGGUACCAUAUCCUUA | 3459 |
| CAGGAAACGTCCTCTTTATA | 366 | GGG | + | CAGGAAACGUCCUCUUUAUA | 3460 |
| AATTGCCTTCACTTAGGCGT | 367 | TGG | + | AAUUGCCUUCACUUAGGCGU | 3461 |
| AGAGGGAGCCTTTGAAACTG | 368 | TGG | + | AGAGGGAGCCUUUGAAACUG | 3462 |
| GCGTGTGCTTGGCGTGTTCC | 369 | AGG | - | GCGUGUGCUUGGCGUGUUCC | 3463 |
| TTGAAAATAAGAAGTTGGCT | 370 | GGG | + | UUGAAAAUAAGAAGUUGGCU | 3464 |
| ATCTGCGGGCAGATTACGCG | 371 | TGG | - | AUCUGCGGGCAGAUUACGCG | 3465 |
| GTAAGCACTGAATGGCCTAC | 372 | AGG | - | GUAAGCACUGAAUGGCCUAC | 3466 |
| CAGGACCATCCAGGGCAAAT | 373 | TGG | + | CAGGACCAUCCAGGGCAAAU | 3467 |
| ATTCTGCCCCTTGGTCCAAA | 374 | AGG | - | AUUCUGCCCCUUGGUCCAAA | 3468 |
| ATGCATAAGGCCCATAGACA | 375 | TGG | + | AUGCAUAAGGCCCAUAGACA | 3469 |
| ATGCATCTTTCCCATGTCTA | 376 | TGG | - | AUGCAUCUUUCCCAUGUCUA | 3470 |
| TCCTGGGTGCAATCCAATTT | 377 | TGG | - | UCCUGGGUGCAAUCCAAUUU | 3471 |
| GCCTTTCCTCATGGGTTGCA | 378 | AGG | + | GCCUUUCCUCAUGGGUUGCA | 3472 |
| AGAGCTGCCATTTGCGGGC | 379 | GGG | - | AGAGCUGCCAUUUGCGGGC | 3473 |
| ACACCCCAATTTGCCCTGGA | 380 | TGG | - | ACACCCCAAUUUGCCCUGGA | 3474 |
| TTTCGCTGTGTCTGTCTACC | 381 | AGG | - | UUUCGCUGUGUCUGUCUACC | 3475 |
| TTACAAAAATGATCCGGGCG | 382 | TGG | - | UUACAAAAAUGAUCCGGGCG | 3476 |
| CTGCTTTCAGAGCCAATTCC | 383 | TGG | - | CUGCUUUCAGAGCCAAUUCC | 3477 |
| CCCCACCCTCAAGAGAAGCT | 384 | GGG | - | CCCCACCCUCAAGAGAAGCU | 3478 |
| GGTTGCCCAGGGGCTGGGGG | 385 | AGG | - | GGUUGCCCAGGGGCUGGGGG | 3479 |
| GTCCACAACATTGTACCAGA | 386 | GGG | + | GUCCACAACAUUGUACCAGA | 3480 |
| ACCTGTGGGCAAAGCATTCT | 387 | GGG | - | ACCUGUGGGCAAAGCAUUCU | 3481 |
| TTCCAAGTAGCTCGGATCAC | 388 | AGG | + | UUCCAAGUAGCUCGGAUCAC | 3482 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CAGTGTGGTGGCTGCAGGTG | 389 | AGG | + | CAGUGUGGUGGCUGCAGGUG | 3483 |
| ATTTTCCCACATTATGTATA | 390 | TGG | + | AUUUUCCCACAUUAUGUAUA | 3484 |
| GGGATGAGCTCTTAAAAGAA | 391 | GGG | - | GGGAUGAGCUCUUAAAAGAA | 3485 |
| TAGAATTTAATATTCCAAAC | 392 | CGG | + | UAGAAUUUAAUAUUCCAAAC | 3486 |
| GAGGTTTCCTGACTCTCAGT | 393 | TGG | - | GAGGUUUCCUGACUCUCAGU | 3487 |
| AATCTAAGCAGACTCTTTCA | 394 | AGG | + | AAUCUAAGCAGACUCUUUCA | 3488 |
| TTTGGGAGACCAAAGGCAAG | 395 | GGG | - | UUUGGGAGACCAAAGGCAAG | 3489 |
| AATGTACCTTGCAACCCATG | 396 | AGG | - | AAUGUACCUUGCAACCCAUG | 3490 |
| AGTGAAATATTTCGATTATG | 397 | TGG | - | AGUGAAAUAUUUCGAUUAUG | 3491 |
| CAGATGCTTCTGGAACTCAA | 398 | GGG | - | CAGAUGCUUCUGGAACUCAA | 3492 |
| AGTAGTGCCCACAGGATCTG | 399 | CGG | - | AGUAGUGCCCACAGGAUCUG | 3493 |
| CTCCTGGGCCCTTGTTCCAC | 400 | TGG | - | CUCCUGGGCCCUUGUUCCAC | 3494 |
| TAATAAGTTTTACATGGCAC | 401 | AGG | + | UAAUAAGUUUUACAUGGCAC | 3495 |
| TCTGCTCAGAATTTCTCCTC | 402 | AGG | + | UCUGCUCAGAAUUUCUCCUC | 3496 |
| AGGAGGGGCAAGGAGTAAA | 403 | AGG | - | AGGAGGGGCAAGGAGUAAA | 3497 |
| TAGAGCTGCCATTTGCGGGG | 404 | CGG | - | UAGAGCUGCCAUUUGCGGGG | 3498 |
| ACAGTTTCAAAGGCTCCCTC | 405 | TGG | - | ACAGUUUCAAAGGCUCCCUC | 3499 |
| CGGTAGCCACTAGTTTCATG | 406 | TGG | + | CGGUAGCCACUAGUUUCAUG | 3500 |
| CCTTACACCCCAATTTGCCC | 407 | TGG | - | CCUUACACCCCAAUUUGCCC | 3501 |
| AAGAAATACAATAAATTAGC | 408 | CGG | - | AAGAAAUACAAUAAAUUAGC | 3502 |
| CTAAACCTGAGTGTAAAAAA | 409 | TGG | - | CUAAACCUGAGUGUAAAAAA | 3503 |
| CCAGTCCCAGCTTCTCTTGA | 410 | GGG | + | CCAGUCCCAGCUUCUCUUGA | 3504 |
| AGAAACGGAAGTCTGAGGCT | 411 | GGG | - | AGAAACGGAAGUCUGAGGCU | 3505 |
| CCCAGGAGAAGACAGGCCAC | 412 | TGG | - | CCCAGGAGAAGACAGGCCAC | 3506 |
| AAGTCGATCCGTGGTTGCCC | 413 | AGG | - | AAGUCGAUCCGUGGUUGCCC | 3507 |
| AAGAAACGGAAGTCTGAGGC | 414 | TGG | - | AAGAAACGGAAGUCUGAGGC | 3508 |
| GCCACGGCAAGTGTGGCAAC | 415 | AGG | - | GCCACGGCAAGUGUGGCAAC | 3509 |
| ATGACGAGGTTGGGGGTGTC | 416 | CGG | - | AUGACGAGGUUGGGGGUGUC | 3510 |
| AAAGCCTAATCACCTCCCAA | 417 | AGG | + | AAAGCCUAAUCACCUCCCAA | 3511 |
| GGTCTCCCAAAAAGAGGATC | 418 | TGG | + | GGUCUCCCAAAAAGAGGAUC | 3512 |
| TAGGTTTGATGGCCTGCTTC | 419 | AGG | + | UAGGUUUGAUGGCCUGCUUC | 3513 |
| CTTGGCGCTATACTAGGACT | 420 | GGG | - | CUUGGCGCUAUACUAGGACU | 3514 |
| GGAAACGCTACCATCAAATA | 421 | TGG | - | GGAAACGCUACCAUCAAAUA | 3515 |
| CCTACTGTGTGCCCTACCCT | 422 | GGG | + | CCUACUGUGUGCCCUACCCU | 3516 |
| CATCCCTCTGGCCCAGGGTA | 423 | GGG | - | CAUCCCUCUGGCCCAGGGUA | 3517 |
| TGGAGCATCCCTCTGGCCCA | 424 | GGG | - | UGGAGCAUCCCUCUGGCCCA | 3518 |
| TGTAGATGCTCTGCTTTTGA | 425 | TGG | + | UGUAGAUGCUCUGCUUUUGA | 3519 |
| GTAGTCCCAGCTACCATGGG | 426 | AGG | + | GUAGUCCCAGCUACCAUGGG | 3520 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| GCTTGGCGCTATACTAGGAC | 427 | TGG | - | GCUUGGCGCUAUACUAGGAC | 3521 |
| AAAAAAACAAGTCTGGGAAA | 428 | TGG | + | AAAAAAACAAGUCUGGGAAA | 3522 |
| TGCCCCCTCCCTCCTGAAGC | 429 | TGG | - | UGCCCCCUCCCUCCUGAAGC | 3523 |
| CTAAAATTACAAAAATGATC | 430 | CGG | - | CUAAAAUUACAAAAAUGAUC | 3524 |
| TCTCTCTGCTCACTTCCATA | 431 | AGG | + | UCUCUCUGCUCACUUCCAUA | 3525 |
| TCCTCTTTTTGGGAGACCAA | 432 | AGG | - | UCCUCUUUUUGGGAGACCAA | 3526 |
| TCACAGAAGCCATCTAAACA | 433 | GGG | + | UCACAGAAGCCAUCUAAACA | 3527 |
| AATGTTTACTGGGTGGGTGG | 434 | AGG | + | AAUGUUUACUGGGUGGGUGG | 3528 |
| GCGCACATGTCTCTTAGCCT | 435 | AGG | - | GCGCACAUGUCUCUUAGCCU | 3529 |
| TGCTGGTTTAAAGCACTGAT | 436 | GGG | - | UGCUGGUUUAAAGCACUGAU | 3530 |
| GCCTTTGGTCTCCCAAAAAG | 437 | AGG | + | GCCUUUGGUCUCCCAAAAAG | 3531 |
| CAGTGCCAGATCCTCTTTTT | 438 | GGG | - | CAGUGCCAGAUCCUCUUUUU | 3532 |
| CGGGCAGATTACGCGTGGCA | 439 | GGG | - | CGGGCAGAUUACGCGUGGCA | 3533 |
| GAGAGTCTTAGGAGATGACG | 440 | AGG | - | GAGAGUCUUAGGAGAUGACG | 3534 |
| AAGGGGCAAGCTAGTGATAC | 441 | TGG | + | AAGGGGCAAGCUAGUGAUAC | 3535 |
| GTGGAGTTTGGCCAGGCTGT | 442 | CGG | + | GUGGAGUUUGGCCAGGCUGU | 3536 |
| CCCACTCTTCTCCGACAGCC | 443 | TGG | - | CCCACUCUUCUCCGACAGCC | 3537 |
| ATATGGCACCTGGACACACA | 444 | AGG | - | AUAUGGCACCUGGACACACA | 3538 |
| GCATTTGTCTGTAGACAGCC | 445 | TGG | - | GCAUUUGUCUGUAGACAGCC | 3539 |
| GTTGCCCAGGGGCTGGGGGA | 446 | GGG | - | GUUGCCCAGGGGCUGGGGGA | 3540 |
| AGATGCTTCTGGAACTCAAG | 447 | GGG | - | AGAUGCUUCUGGAACUCAAG | 3541 |
| GCTGGATTCTGACTACACTG | 448 | GGG | - | GCUGGAUUCUGACUACACUG | 3542 |
| AAAAAAAAAGTCATTGTTCT | 449 | TGG | + | AAAAAAAAAGUCAUUGUUCU | 3543 |
| AGGCCTGGGGGTGGAGCCCG | 450 | AGG | - | AGGCCUGGGGGUGGAGCCCG | 3544 |
| ATTAATGTAGCAAAGTGGAC | 451 | AGG | - | AUUAAUGUAGCAAAGUGGAC | 3545 |
| GCCCTGCAACGTGGGCCAGT | 452 | GGG | + | GCCCUGCAACGUGGGCCAGU | 3546 |
| TTCTCTTACACCGCACATAT | 453 | TGG | + | UUCUCUUACACCGCACAUAU | 3547 |
| AAAAATAGGTTTAAAAATAT | 454 | TGG | + | AAAAAUAGGUUUAAAAAUAU | 3548 |
| CACAACAACTTCGGCCTCCT | 455 | GGG | - | CACAACAACUUCGGCCUCCU | 3549 |
| GCAAGGTTTTATTGAGTGGA | 456 | AGG | - | GCAAGGUUUUAUUGAGUGGA | 3550 |
| TATCTCAGGGTTCTTGCCTT | 457 | GGG | - | UAUCUCAGGGUUCUUGCCUU | 3551 |
| ATGTCTGGGAAGGCCGGGTG | 458 | TGG | + | AUGUCUGGGAAGGCCGGGUG | 3552 |
| TGCATCTTTCCCATGTCTAT | 459 | GGG | - | UGCAUCUUUCCCAUGUCUAU | 3553 |
| TGTGAAAGTGTTACTATTTT | 460 | AGG | - | UGUGAAAGUGUUACUAUUUU | 3554 |
| AAGAAAGAGAATAGATAGTA | 461 | TGG | - | AAGAAAGAGAAUAGAUAGUA | 3555 |
| CTAGCCTATGAGCTTTATGA | 462 | TGG | + | CUAGCCUAUGAGCUUUAUGA | 3556 |
| TCCACGCTGCTGAGGCAGTG | 463 | AGG | - | UCCACGCUGCUGAGGCAGUG | 3557 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TTTCTATGGCCAGCTTCAGG | 464 | AGG | + | UUUCUAUGGCCAGCUUCAGG | 3558 |
| GGGAAGGAACGCTCTATGGT | 465 | TGG | + | GGGAAGGAACGCUCUAUGGU | 3559 |
| GGGCAGATTACGCGTGGCAG | 466 | GGG | - | GGGCAGAUUACGCGUGGCAG | 3560 |
| CTTGCCATCATAAAGCTCAT | 467 | AGG | - | CUUGCCAUCAUAAAGCUCAU | 3561 |
| GAGTTTTGATAGGCACAGGA | 468 | TGG | - | GAGUUUUGAUAGGCACAGGA | 3562 |
| GCAAGAAATGGGTCCAAAAT | 469 | TGG | + | GCAAGAAAUGGGUCCAAAAU | 3563 |
| GGATGGGACAGAGCATCTCC | 470 | TGG | + | GGAUGGGACAGAGCAUCUCC | 3564 |
| GTTCCGCCGGTTGATGGCCT | 471 | GGG | - | GUUCCGCCGGUUGAUGGCCU | 3565 |
| TTTTTACACTCAGGTTTAGT | 472 | CGG | + | UUUUUACACUCAGGUUUAGU | 3566 |
| TGCCCTGCAACGTGGGCCAG | 473 | TGG | + | UGCCCUGCAACGUGGGCCAG | 3567 |
| TGGGCCAGTGGGAAGGTTTG | 474 | GGG | + | UGGGCCAGUGGGAAGGUUUG | 3568 |
| GACAAATGCTTTCTGCGGGA | 475 | GGG | + | GACAAAUGCUUUCUGCGGGA | 3569 |
| CAGATTACGCGTGGCAGGGG | 476 | TGG | - | CAGAUUACGCGUGGCAGGGG | 3570 |
| GCCCTGCAGGAACTGGCTCC | 477 | CGG | + | GCCCUGCAGGAACUGGCUCC | 3571 |
| TCTTTAGCAGGTAGAGTACC | 478 | TGG | + | UCUUUAGCAGGUAGAGUACC | 3572 |
| CACCTACCAAGCCCGACTCC | 479 | AGG | + | CACCUACCAAGCCCGACUCC | 3573 |
| CTCCTGGAGTCGGGCTTGGT | 480 | AGG | - | CUCCUGGAGUCGGGCUUGGU | 3574 |
| GATGCTTTTCTCCTGGAGTC | 481 | GGG | - | GAUGCUUUUCUCCUGGAGUC | 3575 |
| ACTGACCTTCCTAGGTTTGA | 482 | TGG | + | ACUGACCUUCCUAGGUUUGA | 3576 |
| GCAGGCCATCAAACCTAGGA | 483 | AGG | - | GCAGGCCAUCAAACCUAGGA | 3577 |
| CTCATCCCTGACTATCTGCT | 484 | AGG | + | CUCAUCCCUGACUAUCUGCU | 3578 |
| GTGGGCCAGTGGGAAGGTTT | 485 | GGG | + | GUGGGCCAGUGGGAAGGUUU | 3579 |
| AGAATCGATTGAACCCAGGC | 486 | GGG | - | AGAAUCGAUUGAACCCAGGC | 3580 |
| ACGTCCTCTTTATAGGGAAT | 487 | GGG | + | ACGUCCUCUUUAUAGGGAAU | 3581 |
| CTATTTGGCAATTTATACAA | 488 | AGG | - | CUAUUUGGCAAUUUAUACAA | 3582 |
| CAAAAATCAGCTGGGCTTTG | 489 | TGG | - | CAAAAAUCAGCUGGGCUUUG | 3583 |
| GGCTGTGAGGCAGTTTCTGA | 490 | AGG | - | GGCUGUGAGGCAGUUUCUGA | 3584 |
| CGTACAAAGGGGCCGGGCG | 491 | CGG | - | CGUACAAAGGGGCCGGGCG | 3585 |
| CTTCTTATTTTCAAATCCAA | 492 | TGG | - | CUUCUUAUUUUCAAAUCCAA | 3586 |
| CGTTCCGCCGGTTGATGGCC | 493 | TGG | - | CGUUCCGCCGGUUGAUGGCC | 3587 |
| ACTACTACCACATTGGTGAC | 494 | TGG | + | ACUACUACCACAUUGGUGAC | 3588 |
| CACAAGGGGCTTGAGGACCC | 495 | AGG | - | CACAAGGGGCUUGAGGACCC | 3589 |
| TTATAGGGAATGGGCTGAGC | 496 | AGG | + | UUAUAGGGAAUGGGCUGAGC | 3590 |
| CTTTAGCAGGTAGAGTACCT | 497 | GGG | + | CUUUAGCAGGUAGAGUACCU | 3591 |
| CCTAGACACTGCCGTGGGTT | 498 | TGG | + | CCUAGACACUGCCGUGGGUU | 3592 |
| GCTGTGGGCTCCAAACCCA | 499 | CGG | - | GCUGUGGGCUCCAAACCCA | 3593 |
| CATAGCGGGTGAGTAACCAG | 500 | TGG | + | CAUAGCGGGUGAGUAACCAG | 3594 |
| CTCTTAGCCTAGGAAGATTC | 501 | AGG | - | CUCUUAGCCUAGGAAGAUUC | 3595 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TAAAGAAATTGCCTTCACTT | 502 | AGG | + | UAAAGAAAUUGCCUUCACUU | 3596 |
| TTCATCCAACGCCTAAGTGA | 503 | AGG | - | UUCAUCCAACGCCUAAGUGA | 3597 |
| TGGCTGGATTCTGACTACAC | 504 | TGG | - | UGGCUGGAUUCUGACUACAC | 3598 |
| CTACTACCACATTGGTGACT | 505 | GGG | + | CUACUACCACAUUGGUGACU | 3599 |
| TACTTCGATGGGCTATGCAG | 506 | GGG | - | UACUUCGAUGGGCUAUGCAG | 3600 |
| TGTCCAGGTGCCATATTTGA | 507 | TGG | + | UGUCCAGGUGCCAUAUUUGA | 3601 |
| TGCATAAGGCCCATAGACAT | 508 | GGG | + | UGCAUAAGGCCCAUAGACAU | 3602 |
| GCCCAGGGGCTGGGGAGGG | 509 | GGG | - | GCCCAGGGGCUGGGGAGGG | 3603 |
| ACCTTGCAACCCATGAGGAA | 510 | AGG | - | ACCUUGCAACCCAUGAGGAA | 3604 |
| ATTACGCGTGGCAGGGGTGG | 511 | GGG | - | AUUACGCGUGGCAGGGGUGG | 3605 |
| TGTGTGTGTTGGGTGGGAGT | 512 | GGG | - | UGUGUGUGUUGGGUGGGAGU | 3606 |
| ATCATAATACATCTCAGAGG | 513 | TGG | + | AUCAUAAUACAUCUCAGAGG | 3607 |
| CTACCATCCTATGGCCACCA | 514 | GGG | - | CUACCAUCCUAUGGCCACCA | 3608 |
| AACCTCTTTGGAAAACTATT | 515 | TGG | - | AACCUCUUUGGAAAACUAUU | 3609 |
| CCCCTTGTGAGCAGAGAGTG | 516 | AGG | + | CCCCUUGUGAGCAGAGAGUG | 3610 |
| CATGAACCTTGAGATAAGTG | 517 | AGG | - | CAUGAACCUUGAGAUAAGUG | 3611 |
| CAGAAAACTTCACACTGCT | 518 | AGG | + | CAGAAAACUUCACACUGCU | 3612 |
| GGCCCATTTCAGGAGAGAAA | 519 | GGG | + | GGCCCAUUUCAGGAGAGAAA | 3613 |
| TTAAAGCACTGATGGGGTGC | 520 | AGG | - | UUAAAGCACUGAUGGGGUGC | 3614 |
| GCATATTCTGGAAAACTTTT | 521 | AGG | + | GCAUAUUCUGGAAAACUUUU | 3615 |
| CTGGAGCATCCCTCTGGCCC | 522 | AGG | - | CUGGAGCAUCCCUCUGGCCC | 3616 |
| CTCCCCCCTCCCCCAGCCCC | 523 | TGG | + | CUCCCCCCUCCCCCAGCCCC | 3617 |
| TCCCCCCTCCCCCAGCCCCT | 524 | GGG | + | UCCCCCCUCCCCCAGCCCCU | 3618 |
| TCCGTGGTTGCCCAGGGGCT | 525 | GGG | - | UCCGUGGUUGCCCAGGGGCU | 3619 |
| ATCCGTGGTTGCCCAGGGGC | 526 | TGG | - | AUCCGUGGUUGCCCAGGGGC | 3620 |
| CGACAAAGACAGATTAATG | 527 | AGG | + | CGACAAAGACAGAUUAAUG | 3621 |
| AAGATTAGACTGACCTTCCT | 528 | AGG | + | AAGAUUAGACUGACCUUCCU | 3622 |
| CTTGCTGAGGAAAGAGGAGG | 529 | GGG | - | CUUGCUGAGGAAAGAGGAGG | 3623 |
| GCAGAGAGAGAAGGAACGAC | 530 | AGG | - | GCAGAGAGAGAAGGAACGAC | 3624 |
| CTCTGCTCACAAGGGGCTTG | 531 | AGG | - | CUCUGCUCACAAGGGGCUUG | 3625 |
| GACAAAGACAGATTAATGA | 532 | GGG | + | GACAAAGACAGAUUAAUGA | 3626 |
| AAGTATGCAATGAATGTCAA | 533 | TGG | - | AAGUAUGCAAUGAAUGUCAA | 3627 |
| CCCCAGCCCCTGGGCAACCA | 534 | CGG | + | CCCCAGCCCCUGGGCAACCA | 3628 |
| GTGTTACTATTTTAGGCGAC | 535 | AGG | - | GUGUUACUAUUUUAGGCGAC | 3629 |
| AAAGCAGAGCATCTACATCG | 536 | GGG | - | AAAGCAGAGCAUCUACAUCG | 3630 |
| GGGTCTTACTCTTGTCGCCC | 537 | AGG | - | GGGUCUUACUCUUGUCGCCC | 3631 |
| TAAAACTTATTAAATAAGTA | 538 | TGG | - | UAAAACUUAUUAAAUAAGUA | 3632 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| ATCTGTGGGCAAGAAAAAGG | 539 | TGG | + | AUCUGUGGGCAAGAAAAAGG | 3633 |
| GAGTACCTGGGAGAGAGGGT | 540 | GGG | + | GAGUACCUGGGAGAGAGGGU | 3634 |
| CCTCACTCTCTGCTCACAAG | 541 | GGG | - | CCUCACUCUCUGCUCACAAG | 3635 |
| AGCTGGGAACCTGAAGACAA | 542 | AGG | + | AGCUGGGAACCUGAAGACAA | 3636 |
| GCGGGCAGATTACGCGTGGC | 543 | AGG | - | GCGGGCAGAUUACGCGUGGC | 3637 |
| AACACAAGGAAGTAGGGAAC | 544 | AGG | - | AACACAAGGAAGUAGGGAAC | 3638 |
| CTCACCAGACCCAAATCTGC | 545 | TGG | - | CUCACCAGACCCAAAUCUGC | 3639 |
| GAAGGGAGATGCTTTTCTCC | 546 | TGG | - | GAAGGGAGAUGCUUUUCUCC | 3640 |
| AAATGGAGTTTTGGTGGTGT | 547 | AGG | + | AAAUGGAGUUUUGGUGGUGU | 3641 |
| TGAAGCAGGCCATCAAACCT | 548 | AGG | - | UGAAGCAGGCCAUCAAACCU | 3642 |
| AGGTTTGATGGCCTGCTTCA | 549 | GGG | + | AGGUUUGAUGGCCUGCUUCA | 3643 |
| CACCTCTTCTTCCCTGAAGC | 550 | AGG | - | CACCUCUUCUUCCCUGAAGC | 3644 |
| ACAGTGCCAGATCCTCTTTT | 551 | TGG | - | ACAGUGCCAGAUCCUCUUUU | 3645 |
| CTGTTCATCAAGAGATGCAA | 552 | AGG | - | CUGUUCAUCAAGAGAUGCAA | 3646 |
| GGCTGGGGAGGGGGAGAC | 553 | AGG | - | GGCUGGGGAGGGGGAGAC | 3647 |
| ATAATCTGTGGGCAAGAAAA | 554 | AGG | + | AUAAUCUGUGGGCAAGAAAA | 3648 |
| TTATTATTATATGCATCATA | 555 | GGG | + | UUAUUAUUAUAUGCAUCAUA | 3649 |
| TAAACCTATTTTTATAGAGA | 556 | TGG | - | UAAACCUAUUUUUAUAGAGA | 3650 |
| ATCTGCTGGCACCTTGATCG | 557 | TGG | - | AUCUGCUGGCACCUUGAUCG | 3651 |
| TTGTTTCTATGGCCAGCTTC | 558 | AGG | + | UUGUUUCUAUGGCCAGCUUC | 3652 |
| GAGGTGAGTGCAGTCATCCG | 559 | AGG | - | GAGGUGAGUGCAGUCAUCCG | 3653 |
| AAAAGCAGAGCATCTACATC | 560 | GGG | - | AAAAGCAGAGCAUCUACAUC | 3654 |
| CAAGCTAGTGATACTGGAGG | 561 | GGG | + | CAAGCUAGUGAUACUGGAGG | 3655 |
| AGGATAGAGCTGCCATTTGC | 562 | GGG | - | AGGAUAGAGCUGCCAUUUGC | 3656 |
| AGATTACGCGTGGCAGGGGT | 563 | GGG | - | AGAUUACGCGUGGCAGGGGU | 3657 |
| AGGTGAGTGCAGTCATCCGA | 564 | GGG | - | AGGUGAGUGCAGUCAUCCGA | 3658 |
| CCTAGAGTGGTGGAAGCTAA | 565 | AGG | + | CCUAGAGUGGUGGAAGCUAA | 3659 |
| CGATAGACGCCGGCAGCCCC | 566 | AGG | + | CGAUAGACGCCGGCAGCCCC | 3660 |
| CCCCGCTGCTCAAACCTCTG | 567 | GGG | - | CCCCGCUGCUCAAACCUCUG | 3661 |
| ACTTTTCCTCACTTATCTCA | 568 | AGG | + | ACUUUUCCUCACUUAUCUCA | 3662 |
| AATCAGCTGGGCTTTGTGGC | 569 | AGG | - | AAUCAGCUGGGCUUUGUGGC | 3663 |
| GCCAGTCCCAGCTTCTCTTG | 570 | AGG | + | GCCAGUCCCAGCUUCUCUUG | 3664 |
| AGGGGGAGACAGGGAGAAT | 571 | GGG | - | AGGGGGAGACAGGGAGAAU | 3665 |
| GTGTGTGTGTTGGGTGGGAG | 572 | TGG | - | GUGUGUGUGUUGGGUGGGAG | 3666 |
| GGGAGGATCATGAGAGTTGG | 573 | AGG | - | GGGAGGAUCAUGAGAGUUGG | 3667 |
| AAGTGTCCTTCAAGGGGTCA | 574 | TGG | - | AAGUGUCCUUCAAGGGGUCA | 3668 |
| TACCATCCTATGGCCACCAG | 575 | GGG | - | UACCAUCCUAUGGCCACCAG | 3669 |
| CCTACCATCCTATGGCCACC | 576 | AGG | - | CCUACCAUCCUAUGGCCACC | 3670 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CCAGCTACCATGGGAGGCTG | 577 | AGG | + | CCAGCUACCAUGGGAGGCUG | 3671 |
| CTGATTCTTCCGATACCCCA | 578 | AGG | + | CUGAUUCUUCCGAUACCCCA | 3672 |
| CGTGGTTGCCCAGGGGCTGG | 579 | GGG | - | CGUGGUUGCCCAGGGGCUGG | 3673 |
| GAGGATAGAGCTGCCATTTG | 580 | CGG | - | GAGGAUAGAGCUGCCAUUUG | 3674 |
| AGTCTGAGGCTGGGGCAACT | 581 | GGG | - | AGUCUGAGGCUGGGGCAACU | 3675 |
| AGATGCTTTTCTCCTGGAGT | 582 | CGG | - | AGAUGCUUUUCUCCUGGAGU | 3676 |
| CCCATGGTGAGTACTTCGAT | 583 | GGG | - | CCCAUGGUGAGUACUUCGAU | 3677 |
| CAACAATTAATGAGAAAGTA | 584 | TGG | + | CAACAAUUAAUGAGAAAGUA | 3678 |
| CAATTTGCCCTGGATGGTCC | 585 | TGG | - | CAAUUUGCCCUGGAUGGUCC | 3679 |
| CGTAACATACCCAGTACCAC | 586 | TGG | + | CGUAACAUACCCAGUACCAC | 3680 |
| TCTTGCTGAGGAAAGAGGAG | 587 | GGG | - | UCUUGCUGAGGAAAGAGGAG | 3681 |
| GGTCCACAACATTGTACCAG | 588 | AGG | + | GGUCCACAACAUUGUACCAG | 3682 |
| TCATAATACATCTCAGAGGT | 589 | GGG | + | UCAUAAUACAUCUCAGAGGU | 3683 |
| AGGGATGAGCTCTTAAAAGA | 590 | AGG | - | AGGGAUGAGCUCUUAAAAGA | 3684 |
| CCCAGGGTAGGGCACACAGT | 591 | AGG | - | CCCAGGGUAGGGCACACAGU | 3685 |
| TACAGACAAATGCTTTCTGC | 592 | GGG | + | UACAGACAAAUGCUUUCUGC | 3686 |
| TAAAGCGCGCCTTTCCTCAT | 593 | GGG | + | UAAAGCGCGCCUUUCCUCAU | 3687 |
| AGTGGCCCTTTTGGACCAAG | 594 | GGG | + | AGUGGCCCUUUUGGACCAAG | 3688 |
| CCTCACTGAGAAGGTGATGT | 595 | TGG | - | CCUCACUGAGAAGGUGAUGU | 3689 |
| GGAGAAAACACAAGGAAGTA | 596 | GGG | - | GGAGAAAACACAAGGAAGUA | 3690 |
| AAGCTAGTGATACTGGAGGG | 597 | GGG | + | AAGCUAGUGAUACUGGAGGG | 3691 |
| CGTTGAGAGGAGTGCGCCGG | 598 | CGG | + | CGUUGAGAGGAGUGCGCCGG | 3692 |
| TCTGGGAAATGGAGTTTTGG | 599 | TGG | + | UCUGGGAAAUGGAGUUUUGG | 3693 |
| TTGCCCAGGGGCTGGGGGAG | 600 | GGG | - | UUGCCCAGGGGCUGGGGGAG | 3694 |
| GGGGCGAATGTTTACAGCTG | 601 | AGG | - | GGGGCGAAUGUUUACAGCUG | 3695 |
| TCAAAATGTCTGGGAAGGCC | 602 | GGG | + | UCAAAAUGUCUGGGAAGGCC | 3696 |
| TGGCCCATTTCAGGAGAGAA | 603 | AGG | + | UGGCCCAUUUCAGGAGAGAA | 3697 |
| TTCTCAGTATTTGGAAAGAC | 604 | TGG | + | UUCUCAGUAUUUGGAAAGAC | 3698 |
| GGGTGGGAGGTCACAGAAC | 605 | AGG | - | GGGUGGGAGGUCACAGAAC | 3699 |
| TTCTGGACAGTTCATTTCAA | 606 | TGG | + | UUCUGGACAGUUCAUUUCAA | 3700 |
| AGAAAGAAGGAAATTGCTTC | 607 | TGG | - | AGAAAGAAGGAAAUUGCUUC | 3701 |
| GCAAGGTGGTCTAACCTCTT | 608 | TGG | - | GCAAGGUGGUCUAACCUCUU | 3702 |
| TTCCGCCGGTTGATGGCCTG | 609 | GGG | - | UUCCGCCGGUUGAUGGCCUG | 3703 |
| GCCCATGGTGAGTACTTCGA | 610 | TGG | - | GCCCAUGGUGAGUACUUCGA | 3704 |
| GGGGCAAACATTGTGTATGA | 611 | CGG | + | GGGGCAAACAUUGUGUAUGA | 3705 |
| TAAGTATATTTACAGATTTG | 612 | TGG | + | UAAGUAUAUUUACAGAUUUG | 3706 |
| CCGTGGTTGCCCAGGGGCTG | 613 | GGG | - | CCGUGGUUGCCCAGGGGCUG | 3707 |
| AATCTGCCCGCAGATCCTGT | 614 | GGG | + | AAUCUGCCCGCAGAUCCUGU | 3708 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| ACACAAGGAAGTAGGGAACA | 615 | GGG | - | ACACAAGGAAGUAGGGAACA | 3709 |
| GCCAGGCTGTCGGAGAAGAG | 616 | TGG | + | GCCAGGCUGUCGGAGAAGAG | 3710 |
| TTAATGTAGCAAAGTGGACA | 617 | GGG | - | UUAAUGUAGCAAAGUGGACA | 3711 |
| TGCAACGTGGGCCAGTGGGA | 618 | AGG | + | UGCAACGUGGGCCAGUGGGA | 3712 |
| AGCTCCCCAAACCTTCCCAC | 619 | TGG | - | AGCUCCCCAAACCUUCCCAC | 3713 |
| AGAGTGGCCCTTTTGGACCA | 620 | AGG | + | AGAGUGGCCCUUUUGGACCA | 3714 |
| ACTACATTAATGTAGCAAAG | 621 | TGG | - | ACUACAUUAAUGUAGCAAAG | 3715 |
| TGACTAGTCCCATGTGGTAT | 622 | TGG | - | UGACUAGUCCCAUGUGGUAU | 3716 |
| GATGCTATTAATAATTCTGT | 623 | TGG | + | GAUGCUAUUAAUAAUUCUGU | 3717 |
| CTGCCTCGGGCTCCACCCCC | 624 | AGG | + | CUGCCUCGGGCUCCACCCCC | 3718 |
| GGTTGATGGCCTGGGGCTGC | 625 | CGG | - | GGUUGAUGGCCUGGGGCUGC | 3719 |
| TAGTAAGATGTGGGGCCTTT | 626 | GGG | - | UAGUAAGAUGUGGGGCCUUU | 3720 |
| CAACTCCTGAATAGCACATT | 627 | GGG | + | CAACUCCUGAAUAGCACAUU | 3721 |
| CGTTAATCCATATTTAAACT | 628 | AGG | - | CGUUAAUCCAUAUUUAAACU | 3722 |
| GCTGGGGAGGGGGAGACA | 629 | GGG | - | GCUGGGGAGGGGGAGACA | 3723 |
| AGAAGGTTTCAGCGAAGACA | 630 | AGG | - | AGAAGGUUUCAGCGAAGACA | 3724 |
| GAAACGGAAGTCTGAGGCTG | 631 | GGG | - | GAAACGGAAGUCUGAGGCUG | 3725 |
| TCTACGGGAAGATATCCTGT | 632 | AGG | + | UCUACGGGAAGAUAUCCUGU | 3726 |
| GAAAAAAAAAAAACAAGTC | 633 | TGG | + | GAAAAAAAAAAAACAAGUC | 3727 |
| AGAAAACTTCACACTGCTA | 634 | GGG | + | AGAAAACUUCACACUGCUA | 3728 |
| TTCTTGCTGAGGAAAGAGGA | 635 | GGG | - | UUCUUGCUGAGGAAAGAGGA | 3729 |
| CAGGAATTGGCTCTGAAAGC | 636 | AGG | + | CAGGAAUUGGCUCUGAAAGC | 3730 |
| CAAAAGCAGAGCATCTACAT | 637 | CGG | - | CAAAAGCAGAGCAUCUACAU | 3731 |
| CCCGCTGCTCAAACCTCTGG | 638 | GGG | - | CCCGCUGCUCAAACCUCUGG | 3732 |
| CACACTTGCCGTGGCCAGCC | 639 | CGG | + | CACACUUGCCGUGGCCAGCC | 3733 |
| ACCTATTTTTATAGAGATGG | 640 | AGG | - | ACCUAUUUUUAUAGAGAUGG | 3734 |
| AGGAGGGAGGGGGCAGGAGC | 641 | AGG | + | AGGAGGGAGGGGGCAGGAGC | 3735 |
| GTCGATCCGTGGTTGCCCAG | 642 | GGG | - | GUCGAUCCGUGGUUGCCCAG | 3736 |
| CAAGTGGCTGGACGTGCAGA | 643 | AGG | + | CAAGUGGCUGGACGUGCAGA | 3737 |
| GGATTTCTCTTCTTTGTGAT | 644 | TGG | + | GGAUUUCUCUUCUUUGUGAU | 3738 |
| GCAATTAGGGTCTAGTTGGC | 645 | TGG | - | GCAAUUAGGGUCUAGUUGGC | 3739 |
| GGGGGGAGACAGGGAGAATG | 646 | GGG | - | GGGGGGAGACAGGGAGAAUG | 3740 |
| AGAGGGTGGGGCCTCAAAGC | 647 | AGG | + | AGAGGGUGGGGCCUCAAAGC | 3741 |
| CCATCCCACTGCCTGCTTTG | 648 | AGG | - | CCAUCCCACUGCCUGCUUUG | 3742 |
| AAGCAGGCAGTGGGATGGAG | 649 | AGG | + | AAGCAGGCAGUGGGAUGGAG | 3743 |
| CCCCAGAGGTTTGAGCAGCG | 650 | GGG | + | CCCCAGAGGUUUGAGCAGCG | 3744 |
| CAGGGCATGCAAGGGAGGTG | 651 | TGG | - | CAGGGCAUGCAAGGGAGGUG | 3745 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TTTTGTTCGTTATAGAATTT | 652 | TGG | - | UUUUGUUCGUUAUAGAAUUU | 3746 |
| AAATATGATTGGAGGATCAA | 653 | AGG | + | AAAUAUGAUUGGAGGAUCAA | 3747 |
| CTGCTGGTTTAAAGCACTGA | 654 | TGG | - | CUGCUGGUUUAAAGCACUGA | 3748 |
| GATTTTCTTGCTGAGGAAAG | 655 | AGG | - | GAUUUUCUUGCUGAGGAAAG | 3749 |
| CATTTGTCTGTAGACAGCCT | 656 | GGG | - | CAUUUGUCUGUAGACAGCCU | 3750 |
| ATCCGAGGGAGAGAAGATGC | 657 | TGG | - | AUCCGAGGGAGAGAAGAUGC | 3751 |
| CCAACATTGCGGTGTGAAGA | 658 | TGG | + | CCAACAUUGCGGUGUGAAGA | 3752 |
| GTAGTAAGATGTGGGGCCTT | 659 | TGG | - | GUAGUAAGAUGUGGGGCCUU | 3753 |
| TCAACTCCTGAATAGCACAT | 660 | TGG | + | UCAACUCCUGAAUAGCACAU | 3754 |
| AGAAAATAAATTAAAAAGCA | 661 | GGG | + | AGAAAAUAAAUUAAAAAGCA | 3755 |
| CCAAAGGCAAGGGGTGTTGG | 662 | TGG | - | CCAAAGGCAAGGGGUGUUGG | 3756 |
| TTGATGTTGACCTAACTGAC | 663 | AGG | + | UUGAUGUUGACCUAACUGAC | 3757 |
| CCTTCCGCCCGCCCCGCAAA | 664 | TGG | + | CCUUCCGCCCGCCCCGCAAA | 3758 |
| GCTGCCATTTGCGGGGCGGG | 665 | CGG | - | GCUGCCAUUUGCGGGGCGGG | 3759 |
| GGATAGAGCTGCCATTTGCG | 666 | GGG | - | GGAUAGAGCUGCCAUUUGCG | 3760 |
| AGCGAGGAACATCACACACT | 667 | GGG | + | AGCGAGGAACAUCACACACU | 3761 |
| AATATGATTGGAGGATCAAA | 668 | GGG | + | AAUAUGAUUGGAGGAUCAAA | 3762 |
| ATTGAACCCAGGCGGGCGGA | 669 | AGG | - | AUUGAACCCAGGCGGGCGGA | 3763 |
| AAGTCTGAGGCTGGGGCAAC | 670 | TGG | - | AAGUCUGAGGCUGGGGCAAC | 3764 |
| GATTACGCGTGGCAGGGGTG | 671 | GGG | - | GAUUACGCGUGGCAGGGGUG | 3765 |
| TAATCTGCCCGCAGATCCTG | 672 | TGG | + | UAAUCUGCCCGCAGAUCCUG | 3766 |
| ATAGATAGTATGGAAAATTA | 673 | CGG | - | AUAGAUAGUAUGGAAAAUUA | 3767 |
| TGGAGAGGAGAGAAAGCCCC | 674 | TGG | + | UGGAGAGGAGAGAAAGCCCC | 3768 |
| AGAGGAGAGAAAGCCCCTGG | 675 | TGG | + | AGAGGAGAGAAAGCCCCUGG | 3769 |
| GGGCTATGCAGGGGCTGCAG | 676 | TGG | - | GGGCUAUGCAGGGGCUGCAG | 3770 |
| CCAGGGCAAATTGGGGTGTA | 677 | AGG | + | CCAGGGCAAAUUGGGGUGUA | 3771 |
| CGTGGGCCAGTGGGAAGGTT | 678 | TGG | + | CGUGGGCCAGUGGGAAGGUU | 3772 |
| TTGGTGATTAAATCATTGTG | 679 | TGG | + | UUGGUGAUUAAAUCAUUGUG | 3773 |
| TGTCTCTTGCTAGCTCAAAG | 680 | TGG | - | UGUCUCUUGCUAGCUCAAAG | 3774 |
| GGGCAAGCTAGTGATACTGG | 681 | AGG | + | GGGCAAGCUAGUGAUACUGG | 3775 |
| CTTCAATTAGGAAAAATAA | 682 | GGG | + | CUUCAAUUAGGAAAAAUAA | 3776 |
| TAGAAAATAAATTAAAAAGC | 683 | AGG | + | UAGAAAAUAAAUUAAAAAGC | 3777 |
| ACCTACTGTGTGCCCTACCC | 684 | TGG | + | ACCUACUGUGUGCCCUACCC | 3778 |
| GAGTGGCCCTTTTGGACCAA | 685 | GGG | + | GAGUGGCCCUUUUGGACCAA | 3779 |
| ATAATAAAGTGTCCTTCAAG | 686 | GGG | - | AUAAUAAAGUGUCCUUCAAG | 3780 |
| CTCCACCGTCAATAGCATTC | 687 | CGG | - | CUCCACCGUCAAUAGCAUUC | 3781 |
| ATGTTGCTGGTGGGGTGCA | 688 | AGG | - | AUGUUGCUGGUGGGGUGCA | 3782 |
| GTACTTCGATGGGCTATGCA | 689 | GGG | - | GUACUUCGAUGGGCUAUGCA | 3783 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CCCCAGCCATGCACAAAGAT | 690 | TGG | - | CCCCAGCCAUGCACAAAGAU | 3784 |
| AGTACCTGGGAGAGAGGGTG | 691 | GGG | + | AGUACCUGGGAGAGAGGGUG | 3785 |
| GTTTTGATAGGCACAGGATG | 692 | GGG | - | GUUUUGAUAGGCACAGGAUG | 3786 |
| TCTGTAACACACGCCTGCTG | 693 | GGG | + | UCUGUAACACACGCCUGCUG | 3787 |
| AATAGCAAAGTGGTTAAAGG | 694 | AGG | + | AAUAGCAAAGUGGUUAAAGG | 3788 |
| TATCATCAGAAAAGAAAGAA | 695 | AGG | + | UAUCAUCAGAAAAGAAAGAA | 3789 |
| GAATTTAAATTAATTAAAAT | 696 | TGG | - | GAAUUUAAAUUAAUUAAAAU | 3790 |
| CATATATTAGCAGAAACTGA | 697 | TGG | - | CAUAUAUUAGCAGAAACUGA | 3791 |
| GGTGGGGAGGTCACAGAACA | 698 | GGG | - | GGUGGGGAGGUCACAGAACA | 3792 |
| ACAAATGCTTTCTGCGGGAG | 699 | GGG | + | ACAAAUGCUUUCUGCGGGAG | 3793 |
| AGGGCCTCGTGGGCCATGTG | 700 | AGG | - | AGGGCCUCGUGGGCCAUGUG | 3794 |
| CCTGCGCAAAACGCTTTGGC | 701 | GGG | - | CCUGCGCAAAACGCUUUGGC | 3795 |
| CCGCTCCCCCACCCCACGAC | 702 | AGG | - | CCGCUCCCCCACCCCACGAC | 3796 |
| TAAGTACCATATACATAATG | 703 | TGG | - | UAAGUACCAUAUACAUAAUG | 3797 |
| GTGTGTTGGGTGGGAGTGGG | 704 | TGG | - | GUGUGUUGGGUGGGAGUGGG | 3798 |
| AAGAAAAGGTGGACTGAAA | 705 | AGG | + | AAGAAAAGGUGGACUGAAA | 3799 |
| CGTTTTTTAATGGATCCATG | 706 | TGG | + | CGUUUUUUAAUGGAUCCAUG | 3800 |
| AATTTGCCCTGGATGGTCCT | 707 | GGG | - | AAUUUGCCCUGGAUGGUCCU | 3801 |
| GGCTGGATTCTGACTACACT | 708 | GGG | - | GGCUGGAUUCUGACUACACU | 3802 |
| CTCTCCTGCGCAAAACGCTT | 709 | TGG | - | CUCUCCUGCGCAAAACGCUU | 3803 |
| ATCTCGGCTCACAACAACTT | 710 | CGG | - | AUCUCGGCUCACAACAACUU | 3804 |
| TTTTGATAGGCACAGGATGG | 711 | GGG | - | UUUUGAUAGGCACAGGAUGG | 3805 |
| AAAGTGGACAGGGCAGGGAG | 712 | AGG | - | AAAGUGGACAGGGCAGGGAG | 3806 |
| AAGAGGTGAAAGGAATTCGA | 713 | TGG | + | AAGAGGUGAAAGGAAUUCGA | 3807 |
| AGACCAAAGGCAAGGGGTGT | 714 | TGG | - | AGACCAAAGGCAAGGGGUGU | 3808 |
| AAGGTTGCATTGGACACTGC | 715 | TGG | - | AAGGUUGCAUUGGACACUGC | 3809 |
| ACCACACTGCTGTCTCTCCT | 716 | GGG | - | ACCACACUGCUGUCUCUCCU | 3810 |
| AATTAATATCGTTGATAAAT | 717 | AGG | + | AAUUAAUAUCGUUGAUAAAU | 3811 |
| ATGCTATTAATAATTCTGTT | 718 | GGG | + | AUGCUAUUAAUAAUUCUGUU | 3812 |
| AGGGCACCATCCAGCCTGTC | 719 | TGG | + | AGGGCACCAUCCAGCCUGUC | 3813 |
| TCATAGGCTAGTGTGTGTGT | 720 | TGG | - | UCAUAGGCUAGUGUGUGUGU | 3814 |
| GAAGATGGAAGGTCAGTGTT | 721 | GGG | + | GAAGAUGGAAGGUCAGUGUU | 3815 |
| CTGGGGGTGGAGCCCGAGGC | 722 | AGG | - | CUGGGGGUGGAGCCCGAGGC | 3816 |
| TTCTGTCCCTGTGAGAAGGC | 723 | AGG | + | UUCUGUCCCUGUGAGAAGGC | 3817 |
| GTATGTCACTGAAGAGAGTC | 724 | TGG | - | GUAUGUCACUGAAGAGAGUC | 3818 |
| AGTCGATCCGTGGTTGCCCA | 725 | GGG | - | AGUCGAUCCGUGGUUGCCCA | 3819 |
| CGGCGGAACGAGGTGGAGTT | 726 | TGG | + | CGGCGGAACGAGGUGGAGUU | 3820 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TTGTTTAGAAATTATTTTAT | 727 | AGG | - | UUGUUUAGAAAUUAUUUUAU | 3821 |
| GAGGAGAAATTCTGAGCAGA | 728 | TGG | - | GAGGAGAAAUUCUGAGCAGA | 3822 |
| AAACATTGTGTATGACGGCG | 729 | GGG | + | AAACAUUGUGUAUGACGGCG | 3823 |
| TGGAGAAAACACAAGGAAGT | 730 | AGG | - | UGGAGAAAACACAAGGAAGU | 3824 |
| TGAAGATGGAAGGTCAGTGT | 731 | TGG | + | UGAAGAUGGAAGGUCAGUGU | 3825 |
| TTTAAAAATATTGGGTGTGG | 732 | TGG | + | UUUAAAAAUAUUGGGUGUGG | 3826 |
| TAGAAGGCTCCTCACAGAAC | 733 | TGG | - | UAGAAGGCUCCUCACAGAAC | 3827 |
| GGTGTAACCCAGGACCATCC | 734 | AGG | + | GGUGUAACCCAGGACCAUCC | 3828 |
| TTTCTTGCTGAGGAAAGAGG | 735 | AGG | - | UUUCUUGCUGAGGAAAGAGG | 3829 |
| TCTCTTCTTTGTGATTGGCA | 736 | TGG | + | UCUCUUCUUUGUGAUUGGCA | 3830 |
| AATCGTCTGATTGCTGGAGA | 737 | GGG | + | AAUCGUCUGAUUGCUGGAGA | 3831 |
| CATTGCGGTGTGAAGATGGA | 738 | AGG | + | CAUUGCGGUGUGAAGAUGGA | 3832 |
| TGTCGTGGGTGGGGGAGCG | 739 | GGG | + | UGUCGUGGGGUGGGGGAGCG | 3833 |
| GCAAGCTAGTGATACTGGAG | 740 | GGG | + | GCAAGCUAGUGAUACUGGAG | 3834 |
| AGTTTTGATAGGCACAGGAT | 741 | GGG | - | AGUUUUGAUAGGCACAGGAU | 3835 |
| TCACCATGGGCATGGTCCAG | 742 | TGG | + | UCACCAUGGGCAUGGUCCAG | 3836 |
| GGGTACTTGAGAATTGAGAG | 743 | AGG | - | GGGUACUUGAGAAUUGAGAG | 3837 |
| TTTCACTATTTTTCCTTTAG | 744 | AGG | + | UUUCACUAUUUUUCCUUUAG | 3838 |
| GGAACAGGGACTGGTCCTTT | 745 | TGG | - | GGAACAGGGACUGGUCCUUU | 3839 |
| TGTGTTGGGTGGGAGTGGGT | 746 | GGG | - | UGUGUUGGGUGGGAGUGGGU | 3840 |
| ACAAGCGGCTAGATGTCGAG | 747 | AGG | + | ACAAGCGGCUAGAUGUCGAG | 3841 |
| GTGAGTAACCAGTGGAACAA | 748 | GGG | + | GUGAGUAACCAGUGGAACAA | 3842 |
| TTCATCCAGATGTTAGAAAT | 749 | TGG | + | UUCAUCCAGAUGUUAGAAAU | 3843 |
| CGTCTGATTGCTGGAGAGGG | 750 | AGG | + | CGUCUGAUUGCUGGAGAGGG | 3844 |
| GAGGGGGGAGACAGGGAGAA | 751 | TGG | - | GAGGGGGGAGACAGGGAGAA | 3845 |
| TCCTGCGCAAAACGCTTTGG | 752 | CGG | - | UCCUGCGCAAAACGCUUUGG | 3846 |
| AGTTTACCAATCTTTGTGCA | 753 | TGG | + | AGUUUACCAAUCUUUGUGCA | 3847 |
| GCATCCCTCTGGCCCAGGGT | 754 | AGG | - | GCAUCCCUCUGGCCCAGGGU | 3848 |
| GTGTTGGGTGGGAGTGGGTG | 755 | GGG | - | GUGUUGGGUGGGAGUGGGUG | 3849 |
| GAGGCCCCACCCTCTCTCCC | 756 | AGG | - | GAGGCCCCACCCUCUCUCCC | 3850 |
| TCTATCGTGCGCTCTTCCGC | 757 | CGG | - | UCUAUCGUGCGCUCUUCCGC | 3851 |
| TCATTAATTGTTGCAACTTA | 758 | TGG | - | UCAUUAAUUGUUGCAACUUA | 3852 |
| CCAATCCAAGAGACTAAACT | 759 | AGG | + | CCAAUCCAAGAGACUAAACU | 3853 |
| GAACAGGGACTGGTCCTTTT | 760 | GGG | - | GAACAGGGACUGGUCCUUUU | 3854 |
| GAGACAAGTCTCTCTTTAGC | 761 | AGG | + | GAGACAAGUCUCUCUUUAGC | 3855 |
| GGTGAGTAACCAGTGGAACA | 762 | AGG | + | GGUGAGUAACCAGUGGAACA | 3856 |
| TGACCCTTTCTCTCCTGAAA | 763 | TGG | - | UGACCCUUUCUCUCCUGAAA | 3857 |
| TGAGAAAGTATGGCATATTC | 764 | TGG | + | UGAGAAAGUAUGGCAUAUUC | 3858 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| ATTTGTCTGTAGACAGCCTG | 765 | GGG | - | AUUUGUCUGUAGACAGCCUG | 3859 |
| AAGGGGGAGCCCAGACAGGC | 766 | TGG | - | AAGGGGGAGCCCAGACAGGC | 3860 |
| CTGAGGCTGGGGCAACTGGG | 767 | AGG | - | CUGAGGCUGGGGCAACUGGG | 3861 |
| GACGGAGGCAAGAGACAGTC | 768 | TGG | + | GACGGAGGCAAGAGACAGUC | 3862 |
| AAGGGCTGTTTTTGTTTCTA | 769 | TGG | + | AAGGGCUGUUUUUGUUUCUA | 3863 |
| GAACAACAGTTGTCTTTGTG | 770 | TGG | + | GAACAACAGUUGUCUUUGUG | 3864 |
| AATCCAACAGAAAACAGGAT | 771 | GGG | + | AAUCCAACAGAAAACAGGAU | 3865 |
| CTGACTCAATTATAAGACAT | 772 | AGG | - | CUGACUCAAUUAUAAGACAU | 3866 |
| CCATGGGAAGGAACGCTCTA | 773 | TGG | + | CCAUGGGAAGGAACGCUCUA | 3867 |
| CGCAGGAGAGTGGCGGCATC | 774 | AGG | + | CGCAGGAGAGUGGCGGCAUC | 3868 |
| GGCAAGCTAGTGATACTGGA | 775 | GGG | + | GGCAAGCUAGUGAUACUGGA | 3869 |
| TTTAGTTTGCCGTCTGTAGG | 776 | CGG | - | UUUAGUUUGCCGUCUGUAGG | 3870 |
| ATGGAGTTTTGGTGGTGTAG | 777 | GGG | + | AUGGAGUUUUGGUGGUGUAG | 3871 |
| TGTAGCAAAGTGGACAGGGC | 778 | AGG | - | UGUAGCAAAGUGGACAGGGC | 3872 |
| AAATAATGATTATCTTTTTT | 779 | TGG | + | AAAUAAUGAUUAUCUUUUUU | 3873 |
| GACCCTTTCTCTCCTGAAAT | 780 | GGG | - | GACCCUUUCUCUCCUGAAAU | 3874 |
| GTGAAAGAAACGGAAGTCTG | 781 | AGG | - | GUGAAAGAAACGGAAGUCUG | 3875 |
| GGGTGGGGTGTGAAAGAAA | 782 | CGG | - | GGGUGGGGUGUGAAAGAAA | 3876 |
| GCATCATAGGGGTGTGGAAA | 783 | TGG | + | GCAUCAUAGGGGUGUGGAAA | 3877 |
| ATCTGTGTAAAAGAGACTCC | 784 | AGG | - | AUCUGUGUAAAAGAGACUCC | 3878 |
| GGCTATGCAGGGGCTGCAGT | 785 | GGG | - | GGCUAUGCAGGGGCUGCAGU | 3879 |
| AAGTCTGGGAAATGGAGTTT | 786 | TGG | + | AAGUCUGGGAAAUGGAGUUU | 3880 |
| GGAATTCGATGGCCCATTTC | 787 | AGG | + | GGAAUUCGAUGGCCCAUUUC | 3881 |
| TTATCTTACTTGCTTAACGC | 788 | AGG | + | UUAUCUUACUUGCUUAACGC | 3882 |
| GCTGTGAGGCAGTTTCTGAA | 789 | GGG | - | GCUGUGAGGCAGUUUCUGAA | 3883 |
| CGGATGTCTCATGTAACATG | 790 | TGG | + | CGGAUGUCUCAUGUAACAUG | 3884 |
| GGGCACCATCCAGCCTGTCT | 791 | GGG | + | GGGCACCAUCCAGCCUGUCU | 3885 |
| TTATATGCATCATAGGGGTG | 792 | TGG | + | UUAUAUGCAUCAUAGGGGUG | 3886 |
| CTACCATCAAATATGGCACC | 793 | TGG | - | CUACCAUCAAAUAUGGCACC | 3887 |
| TTATTGTATTTCTTGTAGAG | 794 | AGG | + | UUAUUGUAUUUCUUGUAGAG | 3888 |
| TGCCCCTAGCAGATAGTCA | 795 | GGG | - | UGCCCCUAGCAGAUAGUCA | 3889 |
| TTTCTGCGGGAGGGAGTCT | 796 | GGG | + | UUUCUGCGGGAGGGAGUCU | 3890 |
| TGGCGGGTCCCTGTTGCCAG | 797 | GGG | - | UGGCGGGUCCCUGUUGCCAG | 3891 |
| TTTGTTCAAAATGTCTGGGA | 798 | AGG | + | UUUGUUCAAAAUGUCUGGGA | 3892 |
| TGGCTGGGGCTGCTAGTCC | 799 | AGG | - | UGGCUGGGGCUGCUAGUCC | 3893 |
| CCAGCTCGATTTCAACACTG | 800 | GGG | + | CCAGCUCGAUUUCAACACUG | 3894 |
| CAAACTCCACCTCGTTCCGC | 801 | CGG | - | CAAACUCCACCUCGUUCCGC | 3895 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TCTGTGTAAAAGAGACTCCA | 802 | GGG | - | UCUGUGUAAAAGAGACUCCA | 3896 |
| GTGTAACCCAGGACCATCCA | 803 | GGG | + | GUGUAACCCAGGACCAUCCA | 3897 |
| TAAATTAAAAAGCAGGGAGA | 804 | AGG | + | UAAAUUAAAAAGCAGGGAGA | 3898 |
| GCTCTTAAAGAAGGGACCA | 805 | AGG | - | GCUCUUAAAGAAGGGACCA | 3899 |
| TGTGCCCTACCCTGGGCCAG | 806 | AGG | + | UGUGCCCUACCCUGGGCCAG | 3900 |
| ATTATAAGACATAGGAAGCC | 807 | AGG | - | AUUAUAAGACAUAGGAAGCC | 3901 |
| AATGAATTTGAGACGCCTAG | 808 | GGG | - | AAUGAAUUUGAGACGCCUAG | 3902 |
| AAACACTTGGAGACAGAGCG | 809 | AGG | + | AAACACUUGGAGACAGAGCG | 3903 |
| GTCTGCCCAATGTGCTATTC | 810 | AGG | - | GUCUGCCCAAUGUGCUAUUC | 3904 |
| TCATCCCTGACTATCTGCTA | 811 | GGG | + | UCAUCCCUGACUAUCUGCUA | 3905 |
| AGATAAGAAATAGAGAAAAG | 812 | AGG | + | AGAUAAGAAAUAGAGAAAAG | 3906 |
| AAGAAGTTGGCTGGGTGCAG | 813 | TGG | + | AAGAAGUUGGCUGGGUGCAG | 3907 |
| GCAAACATTGTGTATGACGG | 814 | CGG | + | GCAAACAUUGUGUAUGACGG | 3908 |
| GGCCCACGTTGCAGGGCACC | 815 | TGG | - | GGCCCACGUUGCAGGGCACC | 3909 |
| ACCTAGAGTCCAAGGAAGAG | 816 | AGG | - | ACCUAGAGUCCAAGGAAGAG | 3910 |
| GTCTAGAACTACATGCCACA | 817 | GGG | - | GUCUAGAACUACAUGCCACA | 3911 |
| TTTTCTCCTGGAGTCGGGCT | 818 | TGG | - | UUUUCUCCUGGAGUCGGGCU | 3912 |
| ATTCCTTCCCTCCGGGTATA | 819 | GGG | + | AUUCCUUCCCUCCGGGUAUA | 3913 |
| CAAACATTGTGTATGACGGC | 820 | GGG | + | CAAACAUUGUGUAUGACGGC | 3914 |
| CTTTCATAACCAAATCCACT | 821 | TGG | - | CUUUCAUAACCAAAUCCACU | 3915 |
| TGTCACAGCAGGAAATTTCA | 822 | AGG | - | UGUCACAGCAGGAAAUUUCA | 3916 |
| CCTCAGCTCACCATTTGCTC | 823 | TGG | - | CCUCAGCUCACCAUUUGCUC | 3917 |
| GGTGGGAGGATCATGAGAGT | 824 | TGG | - | GGUGGGAGGAUCAUGAGAGU | 3918 |
| GGACTCAGCCCCTGGCAACA | 825 | GGG | + | GGACUCAGCCCCUGGCAACA | 3919 |
| TGGGGCCTCAAAGCAGGCAG | 826 | TGG | + | UGGGGCCUCAAAGCAGGCAG | 3920 |
| CGTGGGTGGGGAGCGGGG | 827 | AGG | + | CGUGGGUGGGGAGCGGGG | 3921 |
| TTCTATGGCCAGCTTCAGGA | 828 | GGG | + | UUCUAUGGCCAGCUUCAGGA | 3922 |
| AGTAAGATATTTTAATACGA | 829 | TGG | - | AGUAAGAUAUUUUAAUACGA | 3923 |
| ACTGAAAAGGCCAGAGCAAA | 830 | TGG | + | ACUGAAAAGGCCAGAGCAAA | 3924 |
| CTGGTGGCCATAGGATGGTA | 831 | GGG | + | CUGGUGGCCAUAGGAUGGUA | 3925 |
| GAGAAAAGAGGCCAGGTGCA | 832 | GGG | + | GAGAAAAGAGGCCAGGUGCA | 3926 |
| TCTTTTAGTTTGCCGTCTGT | 833 | AGG | - | UCUUUUAGUUUGCCGUCUGU | 3927 |
| TGGTACTTATACTTTGATTG | 834 | TGG | + | UGGUACUUAUACUUUGAUUG | 3928 |
| CTTTCTGCGGGAGGGGAGTC | 835 | TGG | + | CUUUCUGCGGGAGGGGAGUC | 3929 |
| TAATGAATTTGAGACGCCTA | 836 | GGG | - | UAAUGAAUUUGAGACGCCUA | 3930 |
| TCACTGCCTCAGCAGCGTGG | 837 | AGG | + | UCACUGCCUCAGCAGCGUGG | 3931 |
| AAAAAAGTGGTTGCAGAAC | 838 | AGG | + | AAAAAAGUGGUUGCAGAAC | 3932 |
| TCTGGGAAGGCCGGGTGTGG | 839 | TGG | + | UCUGGGAAGGCCGGGUGUGG | 3933 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CCAGCCAAAAATAGCCAGTG | 840 | TGG | + | CCAGCCAAAAAUAGCCAGUG | 3934 |
| CCACACTGGCTATTTTTGGC | 841 | TGG | - | CCACACUGGCUAUUUUUGGC | 3935 |
| CAATTAGGGTCTAGTTGGCT | 842 | GGG | - | CAAUUAGGGUCUAGUUGGCU | 3936 |
| TGCCAGCTCGATTTCAACAC | 843 | TGG | + | UGCCAGCUCGAUUUCAACAC | 3937 |
| GAGCTAGCAAGAGACATCTA | 844 | CGG | + | GAGCUAGCAAGAGACAUCUA | 3938 |
| ACTTTTTTTGTGTCCACTGT | 845 | AGG | - | ACUUUUUUUGUGUCCACUGU | 3939 |
| TTAAATAGCAAAGTGGTTAA | 846 | AGG | + | UUAAAUAGCAAAGUGGUUAA | 3940 |
| TGAGGAAAGAGGAGGGGGCA | 847 | AGG | - | UGAGGAAAGAGGAGGGGGCA | 3941 |
| GGGGCCTCAAAGCAGGCAGT | 848 | GGG | + | GGGGCCUCAAAGCAGGCAGU | 3942 |
| ATAGCAAAGTGGTTAAAGGA | 849 | GGG | + | AUAGCAAAGUGGUUAAAGGA | 3943 |
| ATTGTATTTCTTGTAGAGAG | 850 | GGG | + | AUUGUAUUUCUUGUAGAGAG | 3944 |
| AGGGCTTCCCTAAGCCCAAA | 851 | AGG | + | AGGGCUUCCCUAAGCCCAAA | 3945 |
| CAGGCTGTCGGAGAAGAGTG | 852 | GGG | + | CAGGCUGUCGGAGAAGAGUG | 3946 |
| TTCAAAATGTCTGGGAAGGC | 853 | CGG | + | UUCAAAAUGUCUGGGAAGGC | 3947 |
| TGATGTTGACCTAACTGACA | 854 | GGG | + | UGAUGUUGACCUAACUGACA | 3948 |
| AATCTAAGATTGGTGACTGG | 855 | CGG | + | AAUCUAAGAUUGGUGACUGG | 3949 |
| CCATTTGCGGGGCGGGCGGA | 856 | AGG | - | CCAUUUGCGGGGCGGGCGGA | 3950 |
| AGTACTTCGATGGGCTATGC | 857 | AGG | - | AGUACUUCGAUGGGCUAUGC | 3951 |
| GGTTGTTAGACTCAGCACTG | 858 | TGG | - | GGUUGUUAGACUCAGCACUG | 3952 |
| CCTCTCGTGAAAGAGAAAGA | 859 | AGG | - | CCUCUCGUGAAAGAGAAAGA | 3953 |
| AGGTAGAGTACCTGGGAGAG | 860 | AGG | + | AGGUAGAGUACCUGGGAGAG | 3954 |
| AGCTAGCAAGAGACATCTAC | 861 | GGG | + | AGCUAGCAAGAGACAUCUAC | 3955 |
| GACAGCAGTGTGGTGGCTGC | 862 | AGG | + | GACAGCAGUGUGGUGGCUGC | 3956 |
| TGAGACAGGCCGATCACTTG | 863 | AGG | - | UGAGACAGGCCGAUCACUUG | 3957 |
| TGACTACTTTAAGATGCTTT | 864 | GGG | + | UGACUACUUUAAGAUGCUUU | 3958 |
| TTGCCCCCTAGCAGATAGTC | 865 | AGG | - | UUGCCCCCUAGCAGAUAGUC | 3959 |
| AACGTCCTCTTTATAGGGAA | 866 | TGG | + | AACGUCCUCUUUAUAGGGAA | 3960 |
| CTCAGTTTCCTTGTGTGTCC | 867 | AGG | + | CUCAGUUUCCUUGUGUGUCC | 3961 |
| TTCCTTTCAAGTGCTGTTAA | 868 | AGG | - | UUCCUUUCAAGUGCUGUUAA | 3962 |
| CAAAACTCCAAGACCCTAGC | 869 | AGG | + | CAAAACUCCAAGACCCUAGC | 3963 |
| CCAGGCTGTCGGAGAAGAGT | 870 | GGG | + | CCAGGCUGUCGGAGAAGAGU | 3964 |
| GGGTGGCCCTGAATCTTCCT | 871 | AGG | + | GGGUGGCCCUGAAUCUUCCU | 3965 |
| AGCCTCACTCTCTGCTCACA | 872 | AGG | - | AGCCUCACUCUCUGCUCACA | 3966 |
| TATTTCCATTTTTTACACTC | 873 | AGG | + | UAUUUCCAUUUUUUACACUC | 3967 |
| TTTTTGTTATTACTTCTCTT | 874 | TGG | + | UUUUUGUUAUUACUUCUCUU | 3968 |
| GATGGCTTTCCAGTTCTGTG | 875 | AGG | + | GAUGGCUUUCCAGUUCUGUG | 3969 |
| TTCTTCGCATCGCGGGGGTG | 876 | GGG | - | UUCUUCGCAUCGCGGGGGUG | 3970 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| ACGATGTTCTCTGCTCTTCG | 877 | TGG | - | ACGAUGUUCUCUGCUCUUCG | 3971 |
| CTTCATCTGTTTCCATGGGA | 878 | AGG | + | CUUCAUCUGUUUCCAUGGGA | 3972 |
| TCAACACTGGGGTGTCCCCT | 879 | AGG | + | UCAACACUGGGGUGUCCCCU | 3973 |
| GGGTCTATGCTATGTTACCC | 880 | AGG | - | GGGUCUAUGCUAUGUUACCC | 3974 |
| AGAGTACCTGGGAGAGAGGG | 881 | TGG | + | AGAGUACCUGGGAGAGAGGG | 3975 |
| AGGAGCCTTCTAAAGTTCAA | 882 | AGG | + | AGGAGCCUUCUAAAGUUCAA | 3976 |
| GCTTCAATTAGGAAAAAATA | 883 | AGG | + | GCUUCAAUUAGGAAAAAAUA | 3977 |
| ATAAATCTAAGATTGGTGAC | 884 | TGG | + | AUAAAUCUAAGAUUGGUGAC | 3978 |
| ACTCAAGGGGAGCCCAGAC | 885 | AGG | - | ACUCAAGGGGAGCCCAGAC | 3979 |
| GTGGAACTTGAGGATAGACG | 886 | AGG | - | GUGGAACUUGAGGAUAGACG | 3980 |
| GTAGCAAAGTGGACAGGGCA | 887 | GGG | - | GUAGCAAAGUGGACAGGGCA | 3981 |
| AGGAGAAATTCTGAGCAGAT | 888 | GGG | - | AGGAGAAAUUCUGAGCAGAU | 3982 |
| AATAATAAAGTGTCCTTCAA | 889 | GGG | - | AAUAAUAAAGUGUCCUUCAA | 3983 |
| TTGGCGGGTCCCTGTTGCCA | 890 | GGG | - | UUGGCGGGUCCCUGUUGCCA | 3984 |
| AACAGTTGTCTTTGTGTGGA | 891 | TGG | + | AACAGUUGUCUUUGUGUGGA | 3985 |
| CTACAGACAAATGCTTTCTG | 892 | CGG | + | CUACAGACAAAUGCUUUCUG | 3986 |
| TGTAGGCTTGGCGCTATACT | 893 | AGG | - | UGUAGGCUUGGCGCUAUACU | 3987 |
| TTGTGGCACAGTGAGGGAAC | 894 | TGG | + | UUGUGGCACAGUGAGGGAAC | 3988 |
| CTTAAAGTAGTCAGAGTTAC | 895 | TGG | - | CUUAAAGUAGUCAGAGUUAC | 3989 |
| CTTGTAGTCCCAGCTACCAT | 896 | GGG | + | CUUGUAGUCCCAGCUACCAU | 3990 |
| GAGCGAGGAACATCACACAC | 897 | TGG | + | GAGCGAGGAACAUCACACAC | 3991 |
| CTCCAGGGAGCTAGTGAAAC | 898 | AGG | - | CUCCAGGGAGCUAGUGAAAC | 3992 |
| CTCCTGTTTCTCAAGCAGAT | 899 | TGG | + | CUCCUGUUUCUCAAGCAGAU | 3993 |
| GGCGCGCTTTAGATACACAC | 900 | AGG | - | GGCGCGCUUUAGAUACACAC | 3994 |
| CATAGGCTAGTGTGTGTGTT | 901 | GGG | - | CAUAGGCUAGUGUGUGUGUU | 3995 |
| TAGAACTACATGCCACAGGG | 902 | TGG | - | UAGAACUACAUGCCACAGGG | 3996 |
| CATCTCAGGGCATGCAAGGG | 903 | AGG | - | CAUCUCAGGGCAUGCAAGGG | 3997 |
| CGGAATGCTATTGACGGTGG | 904 | AGG | + | CGGAAUGCUAUUGACGGUGG | 3998 |
| TTCGCATCGCGGGGTGGGG | 905 | AGG | - | UUCGCAUCGCGGGGUGGGG | 3999 |
| ATCAGCAATTAGGGTCTAGT | 906 | TGG | - | AUCAGCAAUUAGGGUCUAGU | 4000 |
| ATTTGCGGGCGGGCGGAAG | 907 | GGG | - | AUUUGCGGGCGGGCGGAAG | 4001 |
| GGTGGAAGCTAAAGGAAGAT | 908 | GGG | + | GGUGGAAGCUAAAGGAAGAU | 4002 |
| ACTTCTTCGCATCGCGGGGG | 909 | TGG | - | ACUUCUUCGCAUCGCGGGGG | 4003 |
| CTCCTCATTACAGTGAAATA | 910 | AGG | + | CUCCUCAUUACAGUGAAAUA | 4004 |
| GGAGAAAAGCATCTCCCTTC | 911 | TGG | + | GGAGAAAAGCAUCUCCCUUC | 4005 |
| TGGTGATTAAATCATTGTGT | 912 | GGG | + | UGGUGAUUAAAUCAUUGUGU | 4006 |
| TTTTATAATTGTGATGATAA | 913 | AGG | + | UUUUAUAAUUGUGAUGAUAA | 4007 |
| ATTTAAATTCCAATACCACA | 914 | TGG | + | AUUUAAAUUCCAAUACCACA | 4008 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TGATTGTGTCCTCTGTCCCC | 915 | TGG | - | UGAUUGUGUCCUCUGUCCCC | 4009 |
| ATAATGAATTTGAGACGCCT | 916 | AGG | - | AUAAUGAAUUUGAGACGCCU | 4010 |
| TGAGAAACATAAATCCCGAG | 917 | AGG | + | UGAGAAACAUAAAUCCCGAG | 4011 |
| GTGCCCTACCCTGGGCCAGA | 918 | GGG | + | GUGCCCUACCCUGGGCCAGA | 4012 |
| TGAAATGAACTGTCCAGAAC | 919 | TGG | - | UGAAAUGAACUGUCCAGAAC | 4013 |
| CCATAGAGCGTTCCTTCCCA | 920 | TGG | - | CCAUAGAGCGUUCCUUCCCA | 4014 |
| ATGTCTCATGTAACATGTGG | 921 | TGG | + | AUGUCUCAUGUAACAUGUGG | 4015 |
| TATTATTATATGCATCATAG | 922 | GGG | + | UAUUAUUAUAUGCAUCAUAG | 4016 |
| AGAGAAAAGAGGCCAGGTGC | 923 | AGG | + | AGAGAAAAGAGGCCAGGUGC | 4017 |
| AGCAATGTTTACTGGGTGGG | 924 | TGG | + | AGCAAUGUUUACUGGGUGGG | 4018 |
| CAGTGTTGGGAAGAGTCCAT | 925 | TGG | + | CAGUGUUGGGAAGAGUCCAU | 4019 |
| TGGGACGACAGGTGTAACCC | 926 | AGG | + | UGGGACGACAGGUGUAACCC | 4020 |
| TTCAAAGATTGAGAGGGAAT | 927 | TGG | - | UUCAAAGAUUGAGAGGGAAU | 4021 |
| GGGCCAGAGGGATGCTCCAG | 928 | GGG | + | GGGCCAGAGGGAUGCUCCAG | 4022 |
| CATTTGCGGGCGGGCGGAA | 929 | GGG | - | CAUUUGCGGGCGGGCGGAA | 4023 |
| CACTGCTAGGGTTAAATGAA | 930 | AGG | + | CACUGCUAGGGUUAAAUGAA | 4024 |
| AATACACATAGAAAAATGAC | 931 | AGG | + | AAUACACAUAGAAAAAUGAC | 4025 |
| AGACCCATCCTGTTTTCTGT | 932 | TGG | - | AGACCCAUCCUGUUUUCUGU | 4026 |
| CTATGCTATGTTACCCAGGC | 933 | TGG | - | CUAUGCUAUGUUACCCAGGC | 4027 |
| TTGCTGGTGGGGTGCAAGG | 934 | TGG | - | UUGCUGGUGGGGUGCAAGG | 4028 |
| CACTGGTTACTCACCCGCTA | 935 | TGG | - | CACUGGUUACUCACCCGCUA | 4029 |
| CACCACACTGCTGTCTCTCC | 936 | TGG | - | CACCACACUGCUGUCUCUCC | 4030 |
| GGGACTAGTCATGACTACAT | 937 | TGG | + | GGGACUAGUCAUGACUACAU | 4031 |
| TTATTAGATTCCAGTGGTAC | 938 | TGG | - | UUAUUAGAUUCCAGUGGUAC | 4032 |
| CTACTTAGAAATATACCTTG | 939 | GGG | - | CUACUUAGAAAUAUACCUUG | 4033 |
| TCGAACAATAGACTTTCAAT | 940 | GGG | - | UCGAACAAUAGACUUUCAAU | 4034 |
| GACAGGGAGAATGGGGAGCG | 941 | AGG | - | GACAGGGAGAAUGGGGAGCG | 4035 |
| CCAACATCACCTTCTCAGTG | 942 | AGG | + | CCAACAUCACCUUCUCAGUG | 4036 |
| CCTCAAAGCAGGCAGTGGGA | 943 | TGG | + | CCUCAAAGCAGGCAGUGGGA | 4037 |
| ATCGGGTATGTTTACACAA | 944 | TGG | - | AUCGGGUAUGUUUACACAA | 4038 |
| TTTCGTACAATACTGGAGGC | 945 | TGG | + | UUUCGUACAAUACUGGAGGC | 4039 |
| TTCGCCCCTAGACACTGCCG | 946 | TGG | + | UUCGCCCCUAGACACUGCCG | 4040 |
| TGCCCTGAGATGGGGACAAG | 947 | GGG | + | UGCCCUGAGAUGGGGACAAG | 4041 |
| GGGAGCTAGTGAAACAGGAA | 948 | AGG | - | GGGAGCUAGUGAAACAGGAA | 4042 |
| AATCTTAAATCATCTAATTG | 949 | TGG | + | AAUCUUAAAUCAUCUAAUUG | 4043 |
| AAATCCAACAGAAAACAGGA | 950 | TGG | + | AAAUCCAACAGAAAACAGGA | 4044 |
| ATGTAAACCAGTTGTCTGTT | 951 | AGG | + | AUGUAAACCAGUUGUCUGUU | 4045 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| ACCAAATCCACTTGGCTCAA | 952 | AGG | - | ACCAAAUCCACUUGGCUCAA | 4046 |
| ATCGAACAATAGACTTTCAA | 953 | TGG | - | AUCGAACAAUAGACUUUCAA | 4047 |
| AGGCTAGTGTGTGTTGGG | 954 | TGG | - | AGGCUAGUGUGUGUUGGG | 4048 |
| GGGACTCAGCCCCTGGCAAC | 955 | AGG | + | GGGACUCAGCCCCUGGCAAC | 4049 |
| TTTGGCGGGTCCCTGTTGCC | 956 | AGG | - | UUUGGCGGGUCCCUGUUGCC | 4050 |
| TTAGCTGAGCGTGGCAGCGC | 957 | AGG | + | UUAGCUGAGCGUGGCAGCGC | 4051 |
| AGTCTAGAACTACATGCCAC | 958 | AGG | - | AGUCUAGAACUACAUGCCAC | 4052 |
| TGTCGAGAGGAGCACATTGG | 959 | CGG | + | UGUCGAGAGGAGCACAUUGG | 4053 |
| TGTGGTAGTAGTAAGATGTG | 960 | GGG | - | UGUGGUAGUAGUAAGAUGUG | 4054 |
| ACTGCTAGGGTTAAATGAAA | 961 | GGG | + | ACUGCUAGGGUUAAAUGAAA | 4055 |
| AAAAAATCCTAACAGACAAC | 962 | TGG | - | AAAAAAUCCUAACAGACAAC | 4056 |
| TGTGGCACAGTGAGGGAACT | 963 | GGG | + | UGUGGCACAGUGAGGGAACU | 4057 |
| TAATTAAAATTGGCCGGGCG | 964 | GGG | - | UAAUUAAAAUUGGCCGGGCG | 4058 |
| CCAAACCGGAATGCTATTGA | 965 | CGG | + | CCAAACCGGAAUGCUAUUGA | 4059 |
| TCTATTTCTTATCTCCTGAG | 966 | TGG | - | UCUAUUUCUUAUCUCCUGAG | 4060 |
| TCTGTCCCTGTGAGAAGGCA | 967 | GGG | + | UCUGUCCCUGUGAGAAGGCA | 4061 |
| CTCGGCTTCATCTGTTTCCA | 968 | TGG | + | CUCGGCUUCAUCUGUUUCCA | 4062 |
| GAGAGTTGGAGGCTGCAGTG | 969 | AGG | - | GAGAGUUGGAGGCUGCAGUG | 4063 |
| TAAAAGAGAAACCTTGGGCC | 970 | GGG | + | UAAAAGAGAAACCUUGGGCC | 4064 |
| TATTCCTTCCCTCCGGGTAT | 971 | AGG | + | UAUUCCUUCCCUCCGGGUAU | 4065 |
| CCAAGGTATATTTCTAAGTA | 972 | GGG | + | CCAAGGUAUAUUUCUAAGUA | 4066 |
| CAAAAATAGCCAGTGTGGCT | 973 | TGG | + | CAAAAAUAGCCAGUGUGGCU | 4067 |
| ACAGGGAGAATGGGGAGCGA | 974 | GGG | - | ACAGGGAGAAUGGGGAGCGA | 4068 |
| AATATTGGGTGTGGTGGCAC | 975 | GGG | + | AAUAUUGGGUGUGGUGGCAC | 4069 |
| TTCCTGTTTCACTAGCTCCC | 976 | TGG | + | UUCCUGUUUCACUAGCUCCC | 4070 |
| AAGTACCATATACATAATGT | 977 | GGG | - | AAGUACCAUAUACAUAAUGU | 4071 |
| AAATTATGAATGATTAAAAA | 978 | TGG | - | AAAUUAUGAAUGAUUAAAAA | 4072 |
| TTCGTACAATACTGGAGGCT | 979 | GGG | + | UUCGUACAAUACUGGAGGCU | 4073 |
| ATAAAAGAGAAACCTTGGGC | 980 | CGG | + | AUAAAAGAGAAACCUUGGGC | 4074 |
| TGTTTTTATTAGATTCCAG | 981 | TGG | - | UGUUUUUUAUUAGAUUCCAG | 4075 |
| CCTACTTAGAAATATACCTT | 982 | GGG | - | CCUACUUAGAAAUAUACCUU | 4076 |
| GCAGAGAACATCGTCTCTCC | 983 | AGG | + | GCAGAGAACAUCGUCUCUCC | 4077 |
| TGTCCCCTGGAGCATCCCTC | 984 | TGG | - | UGUCCCCUGGAGCAUCCCUC | 4078 |
| CTCTAAAGATTTGCCAGTTC | 985 | TGG | + | CUCUAAAGAUUUGCCAGUUC | 4079 |
| TTCTCAAGCAGATTGGAAGC | 986 | TGG | + | UUCUCAAGCAGAUUGGAAGC | 4080 |
| GGTAGAGTACCTGGGAGAGA | 987 | GGG | + | GGUAGAGUACCUGGGAGAGA | 4081 |
| CCAGGGATGAAGCAGGAAGC | 988 | AGG | - | CCAGGGAUGAAGCAGGAAGC | 4082 |
| CCAAACCCACGGCAGTGTCT | 989 | AGG | - | CCAAACCCACGGCAGUGUCU | 4083 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CAGGAGAGACAGCAGTGTGG | 990 | TGG | + | CAGGAGAGACAGCAGUGUGG | 4084 |
| GCCTCACTCTCTGCTCACAA | 991 | GGG | - | GCCUCACUCUCUGCUCACAA | 4085 |
| GAAAAATGACAGGAAATGAC | 992 | GGG | + | GAAAAAUGACAGGAAAUGAC | 4086 |
| CAAGCCACACTGGCTATTTT | 993 | TGG | - | CAAGCCACACUGGCUAUUUU | 4087 |
| TCGGATGACTGCACTCACCT | 994 | CGG | + | UCGGAUGACUGCACUCACCU | 4088 |
| AGTAGGTTGCCAAGCCACAC | 995 | TGG | - | AGUAGGUUGCCAAGCCACAC | 4089 |
| ACTCTCTTCAGTGACATACA | 996 | TGG | + | ACUCUCUUCAGUGACAUACA | 4090 |
| AAAAGGGCCACTCTGCTGTG | 997 | AGG | - | AAAAGGGCCACUCUGCUGUG | 4091 |
| ATGTTGGAGCAAAGATTCGA | 998 | AGG | - | AUGUUGGAGCAAAGAUUCGA | 4092 |
| CAACATCACCTTCTCAGTGA | 999 | GGG | + | CAACAUCACCUUCUCAGUGA | 4093 |
| TAATAATAAAGTGTCCTTCA | 1000 | AGG | - | UAAUAAUAAAGUGUCCUUCA | 4094 |
| AAAAAAGTGGTTGCAGAACA | 1001 | GGG | + | AAAAAAGUGGUUGCAGAACA | 4095 |
| AATGGAGTTTTGGTGGTGTA | 1002 | GGG | + | AAUGGAGUUUUGGUGGUGUA | 4096 |
| TTAAAGTAGTCAGAGTTACT | 1003 | GGG | - | UUAAAGUAGUCAGAGUUACU | 4097 |
| GGTCTAATTTTAAAATGCTT | 1004 | TGG | - | GGUCUAAUUUUAAAAUGCUU | 4098 |
| TAAATGAGAAAAGCATAACA | 1005 | AGG | + | UAAAUGAGAAAAGCAUAACA | 4099 |
| AATTAGGGTCTAGTTGGCTG | 1006 | GGG | - | AAUUAGGGUCUAGUUGGCUG | 4100 |
| GGGAGCGAGGGCTTAATGTT | 1007 | TGG | - | GGGAGCGAGGGCUUAAUGUU | 4101 |
| TGTCTTTCGCTTAGCATATG | 1008 | TGG | + | UGUCUUUCGCUUAGCAUAUG | 4102 |
| TTGGAGCAAAGATTCGAAGG | 1009 | AGG | - | UUGGAGCAAAGAUUCGAAGG | 4103 |
| TTAACACAATTAGCTGAGCG | 1010 | TGG | + | UUAACACAAUUAGCUGAGCG | 4104 |
| TTGTACGAAATAAATTTCTG | 1011 | TGG | - | UUGUACGAAAUAAAUUUCUG | 4105 |
| GAAAGCAGGCCTCTCTTCCT | 1012 | TGG | + | GAAAGCAGGCCUCUCUUCCU | 4106 |
| CATGAGATGCATCCACCCTG | 1013 | TGG | + | CAUGAGAUGCAUCCACCCUG | 4107 |
| TCAGCACTGTGGAAGAAACA | 1014 | AGG | - | UCAGCACUGUGGAAGAAACA | 4108 |
| CTTCTTCGCATCGCGGGGGT | 1015 | GGG | - | CUUCUUCGCAUCGCGGGGGU | 4109 |
| AACCAGTGGAACAAGGGCCC | 1016 | AGG | + | AACCAGUGGAACAAGGGCCC | 4110 |
| CTTCCCTCCGGGTATAGGGC | 1017 | AGG | + | CUUCCCUCCGGGUAUAGGGC | 4111 |
| ATCCCTGACTATCTGCTAGG | 1018 | GGG | + | AUCCCUGACUAUCUGCUAGG | 4112 |
| TCGGCTTCATCTGTTTCCAT | 1019 | GGG | + | UCGGCUUCAUCUGUUUCCAU | 4113 |
| AGGCAAAGAAATTCTATGGA | 1020 | CGG | + | AGGCAAAGAAAUUCUAUGGA | 4114 |
| CCTGGTGGCCATAGGATGGT | 1021 | AGG | + | CCUGGUGGCCAUAGGAUGGU | 4115 |
| CAGCGCGTGGTCCCTGCCTC | 1022 | GGG | + | CAGCGCGUGGUCCCUGCCUC | 4116 |
| TGGGGGTGGAGCCCGAGGCA | 1023 | GGG | - | UGGGGGUGGAGCCCGAGGCA | 4117 |
| GAGAAACCTTGGGCCGGGCA | 1024 | TGG | + | GAGAAACCUUGGGCCGGGCA | 4118 |
| CTGACTACTTTAAGATGCTT | 1025 | TGG | + | CUGACUACUUUAAGAUGCUU | 4119 |
| GATGGATGGCGAAGCCACTC | 1026 | AGG | + | GAUGGAUGGCGAAGCCACUC | 4120 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| GCTTTGGTGGTAAAAAATAC | 1027 | AGG | + | GCUUUGGUGGUAAAAAAUAC | 4121 |
| CCCAAGGTATATTTCTAAGT | 1028 | AGG | + | CCCAAGGUAUAUUUCUAAGU | 4122 |
| GGCTAGTGTGTGTGTTGGGT | 1029 | GGG | - | GGCUAGUGUGUGUGUUGGGU | 4123 |
| CCTCAGCCTCCCATGGTAGC | 1030 | TGG | - | CCUCAGCCUCCCAUGGUAGC | 4124 |
| GCAGCGCGTGGTCCCTGCCT | 1031 | CGG | + | GCAGCGCGUGGUCCCUGCCU | 4125 |
| TATTAGATTCCAGTGGTACT | 1032 | GGG | - | UAUUAGAUUCCAGUGGUACU | 4126 |
| GAAAACCTAGTTTAGTCTCT | 1033 | TGG | - | GAAAACCUAGUUUAGUCUCU | 4127 |
| CTGGAGTCGGGCTTGGTAGG | 1034 | TGG | - | CUGGAGUCGGGCUUGGUAGG | 4128 |
| ATTAATTAAAATTGGCCGGG | 1035 | CGG | - | AUUAAUUAAAAUUGGCCGGG | 4129 |
| AGATTCATTCATTCATTCCT | 1036 | TGG | + | AGAUUCAUUCAUUCAUUCCU | 4130 |
| TTCACTTAGGCGTTGGATGA | 1037 | AGG | + | UUCACUUAGGCGUUGGAUGA | 4131 |
| TTTGAGGCAAAGAAATTCTA | 1038 | TGG | + | UUUGAGGCAAAGAAAUUCUA | 4132 |
| GAGACAGTCTGGCACATTTG | 1039 | TGG | + | GAGACAGUCUGGCACAUUUG | 4133 |
| CTCAGCCTCCCATGGTAGCT | 1040 | GGG | - | CUCAGCCUCCCAUGGUAGCU | 4134 |
| CTCCCTTGCATGCCCTGAGA | 1041 | TGG | + | CUCCCUUGCAUGCCCUGAGA | 4135 |
| TTAATTAAAATTGGCCGGGC | 1042 | GGG | - | UUAAUUAAAAUUGGCCGGGC | 4136 |
| TAGTCATGACTAGTCCCATG | 1043 | TGG | - | UAGUCAUGACUAGUCCCAUG | 4137 |
| TAGTCACATTTCTCAGTATT | 1044 | TGG | + | UAGUCACAUUUCUCAGUAUU | 4138 |
| TGAGGAGACACTGCCACTGA | 1045 | AGG | - | UGAGGAGACACUGCCACUGA | 4139 |
| CTGAGCAAACCTAGAGTCCA | 1046 | AGG | - | CUGAGCAAACCUAGAGUCCA | 4140 |
| AGCTTCAGGAGGGAGGGGGC | 1047 | AGG | + | AGCUUCAGGAGGGAGGGGGC | 4141 |
| AACGTTTCTATCATCGCAGA | 1048 | AGG | - | AACGUUUCUAUCAUCGCAGA | 4142 |
| TGTATGACGGCGGGGCGCGG | 1049 | TGG | + | UGUAUGACGGCGGGGCGCGG | 4143 |
| TGGGCCAGAGGGATGCTCCA | 1050 | GGG | + | UGGGCCAGAGGGAUGCUCCA | 4144 |
| ATTAGGGTCTAGTTGGCTGG | 1051 | GGG | - | AUUAGGGUCUAGUUGGCUGG | 4145 |
| AGAAAATGACAGGAAATGA | 1052 | CGG | + | AGAAAAUGACAGGAAAUGA | 4146 |
| GTGTGATATTCCTTCCCTCC | 1053 | GGG | + | GUGUGAUAUUCCUUCCCUCC | 4147 |
| TTGTGTATGACGGCGGGGCG | 1054 | CGG | + | UUGUGUAUGACGGCGGGGCG | 4148 |
| CCAATCTTTGTGCATGGCTG | 1055 | GGG | + | CCAAUCUUUGUGCAUGGCUG | 4149 |
| TGCAAAGGAAATCAGCAATT | 1056 | AGG | - | UGCAAAGGAAAUCAGCAAUU | 4150 |
| AGAAAGCCCCTGGTGGCCAT | 1057 | AGG | + | AGAAAGCCCCUGGUGGCCAU | 4151 |
| GCTATTAAAAAGGATGAGGT | 1058 | CGG | + | GCUAUUAAAAAGGAUGAGGU | 4152 |
| TATGGCCAGCTTCAGGAGGG | 1059 | AGG | + | UAUGGCCAGCUUCAGGAGGG | 4153 |
| TTATCAGTCATTTTTTGTAT | 1060 | GGG | + | UUAUCAGUCAUUUUUUGUAU | 4154 |
| CCATAGGATGGTAGGGATTT | 1061 | AGG | + | CCAUAGGAUGGUAGGGAUUU | 4155 |
| CCACTGAAGGACAGAAGCAG | 1062 | TGG | - | CCACUGAAGGACAGAAGCAG | 4156 |
| AGGGTTTCCTCACAGCAGAG | 1063 | TGG | + | AGGGUUUCCUCACAGCAGAG | 4157 |
| GCCAGCTCGATTTCAACACT | 1064 | GGG | + | GCCAGCUCGAUUUCAACACU | 4158 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| AAGTTCCACAAAGCCTCACA | 1065 | TGG | + | AAGUUCCACAAAGCCUCACA | 4159 |
| ATTATCAGTCATTTTTGTA | 1066 | TGG | + | AUUAUCAGUCAUUUUUGUA | 4160 |
| CTATCTCCATGACCCCTTGA | 1067 | AGG | + | CUAUCUCCAUGACCCCUUGA | 4161 |
| GACTACTTTAAGATGCTTTG | 1068 | GGG | + | GACUACUUUAAGAUGCUUUG | 4162 |
| GACTGGTCCTTTTGGGCTTA | 1069 | GGG | - | GACUGGUCCUUUUGGGCUUA | 4163 |
| ATGTGGTAGTAGTAAGATGT | 1070 | GGG | - | AUGUGGUAGUAGUAAGAUGU | 4164 |
| TACATGGCCTTTGAGCCAAG | 1071 | TGG | + | UACAUGGCCUUUGAGCCAAG | 4165 |
| CATCAACCGGCGGAACGAGG | 1072 | TGG | + | CAUCAACCGGCGGAACGAGG | 4166 |
| GGACTGGTCCTTTTGGGCTT | 1073 | AGG | - | GGACUGGUCCUUUUGGGCUU | 4167 |
| TGGTGTATCTGCTTCAGCAT | 1074 | TGG | + | UGGUGUAUCUGCUUCAGCAU | 4168 |
| AAATATTGGGTGTGGTGGCA | 1075 | CGG | + | AAAUAUUGGGUGUGGUGGCA | 4169 |
| GAAACATAAATCCCGAGAGG | 1076 | TGG | + | GAAACAUAAAUCCCGAGAGG | 4170 |
| CTACCTCCTGCCCACCTCTC | 1077 | GGG | - | CUACCUCCUGCCCACCUCUC | 4171 |
| AGATGTCGAGAGGAGCACAT | 1078 | TGG | + | AGAUGUCGAGAGGAGCACAU | 4172 |
| CTCTGTAACACACGCCTGCT | 1079 | GGG | + | CUCUGUAACACACGCCUGCU | 4173 |
| CTGGGCCAGAGGGATGCTCC | 1080 | AGG | + | CUGGGCCAGAGGGAUGCUCC | 4174 |
| AAAATAGGTTTAAAAATATT | 1081 | GGG | + | AAAAUAGGUUUAAAAAUAUU | 4175 |
| AAACCTTGGGCCGGGCATGG | 1082 | TGG | + | AAACCUUGGGCCGGGCAUGG | 4176 |
| CAGAGCAAATGGTGAGCTGA | 1083 | GGG | + | CAGAGCAAAUGGUGAGCUGA | 4177 |
| ACCTTCATTGCTACTTGAGA | 1084 | AGG | + | ACCUUCAUUGCUACUUGAGA | 4178 |
| CTAGTTTAGTCTCTTGGATT | 1085 | GGG | - | CUAGUUUAGUCUCUUGGAUU | 4179 |
| AGTCTGGCACATTTGTGGCT | 1086 | TGG | + | AGUCUGGCACAUUUGUGGCU | 4180 |
| ACATATGAGCATTTCCAGTT | 1087 | TGG | + | ACAUAUGAGCAUUUCCAGUU | 4181 |
| CCCTACTTAGAAATATACCT | 1088 | TGG | - | CCCUACUUAGAAAUAUACCU | 4182 |
| ATATGGTACCTCAGAACCCC | 1089 | AGG | + | AUAUGGUACCUCAGAACCCC | 4183 |
| GAAACCTTGTTGTCACAGC | 1090 | AGG | - | GAAACCUUGUUGUCACAGC | 4184 |
| TGGTGGAAGCTAAAGGAAGA | 1091 | TGG | + | UGGUGGAAGCUAAAGGAAGA | 4185 |
| CATATGAGCATTTCCAGTTT | 1092 | GGG | + | CAUAUGAGCAUUUCCAGUUU | 4186 |
| TCGCCCCTAGACACTGCCGT | 1093 | GGG | + | UCGCCCCUAGACACUGCCGU | 4187 |
| CATCCCTGACTATCTGCTAG | 1094 | GGG | + | CAUCCCUGACUAUCUGCUAG | 4188 |
| GCAAAGGAAATCAGCAATTA | 1095 | GGG | - | GCAAAGGAAAUCAGCAAUUA | 4189 |
| CCAGAGCAAATGGTGAGCTG | 1096 | AGG | + | CCAGAGCAAAUGGUGAGCUG | 4190 |
| TTTGTTTTGTTCAAAATGTC | 1097 | TGG | + | UUUGUUUUGUUCAAAAUGUC | 4191 |
| GTGTCCTGCCCTATACCCGG | 1098 | AGG | - | GUGUCCUGCCCUAUACCCGG | 4192 |
| GTAGACAGCCTGGGGTTCTG | 1099 | AGG | - | GUAGACAGCCUGGGGUUCUG | 4193 |
| TAATTTTATGCTTTTCTTCT | 1100 | CGG | + | UAAUUUUAUGCUUUUCUUCU | 4194 |
| CCCCAGTGTTGAAATCGAGC | 1101 | TGG | - | CCCCAGUGUUGAAAUCGAGC | 4195 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TGGGGTTTGCAGAATGACCT | 1102 | TGG | - | UGGGGUUUGCAGAAUGACCU | 4196 |
| CCTAAATCCCTACCATCCTA | 1103 | TGG | - | CCUAAAUCCCUACCAUCCUA | 4197 |
| CAAACCCACGGCAGTGTCTA | 1104 | GGG | - | CAAACCCACGGCAGUGUCUA | 4198 |
| CAGTGGAAGTGTTAAGTGGC | 1105 | TGG | - | CAGUGGAAGUGUUAAGUGGC | 4199 |
| GTGATGATAAAGGCTTTGTG | 1106 | TGG | + | GUGAUGAUAAAGGCUUUGUG | 4200 |
| TATGGGTTTCTATAATCTGT | 1107 | GGG | + | UAUGGGUUUCUAUAAUCUGU | 4201 |
| ACTGCTGTGGAGAAAACACA | 1108 | AGG | - | ACUGCUGUGGAGAAAACACA | 4202 |
| CCCCATCTCAGGGCATGCAA | 1109 | GGG | - | CCCCAUCUCAGGGCAUGCAA | 4203 |
| AATGTGGTAGTAGTAAGATG | 1110 | TGG | - | AAUGUGGUAGUAGUAAGAUG | 4204 |
| TATTATTTCAAAGATTGAGA | 1111 | GGG | - | UAUUAUUUCAAAGAUUGAGA | 4205 |
| ATATTATTTCAAAGATTGAG | 1112 | AGG | - | AUAUUAUUUCAAAGAUUGAG | 4206 |
| AAACCCACGGCAGTGTCTAG | 1113 | GGG | - | AAACCCACGGCAGUGUCUAG | 4207 |
| AGGGATGCTCCAGGGGACAG | 1114 | AGG | + | AGGGAUGCUCCAGGGGACAG | 4208 |
| CAGAGGTGGGACTCAGCCCC | 1115 | TGG | + | CAGAGGUGGGACUCAGCCCC | 4209 |
| AGCAACATATGACACAGTTC | 1116 | AGG | + | AGCAACAUAUGACACAGUUC | 4210 |
| AGTGAGGCTTCCATTTCAGA | 1117 | AGG | + | AGUGAGGCUUCCAUUUCAGA | 4211 |
| TTCAGGGAAGAAGAGGTGAA | 1118 | AGG | + | UUCAGGGAAGAAGAGGUGAA | 4212 |
| TTTCAGGAGAGAAAGGGTCA | 1119 | AGG | + | UUUCAGGAGAGAAAGGGUCA | 4213 |
| TCCCCATCTCAGGGCATGCA | 1120 | AGG | - | UCCCCAUCUCAGGGCAUGCA | 4214 |
| AGCCCCTGGTGGCCATAGGA | 1121 | TGG | + | AGCCCCUGGUGGCCAUAGGA | 4215 |
| GAATCGTCTGATTGCTGGAG | 1122 | AGG | + | GAAUCGUCUGAUUGCUGGAG | 4216 |
| AAGACATAGGAAGCCAGGTG | 1123 | CGG | - | AAGACAUAGGAAGCCAGGUG | 4217 |
| GCCTCTCTTCCTTGGACTCT | 1124 | AGG | + | GCCUCUCUUCCUUGGACUCU | 4218 |
| GGAGCGAGGGCTTAATGTTT | 1125 | GGG | - | GGAGCGAGGGCUUAAUGUUU | 4219 |
| ACATTGCATAAATCTAAGAT | 1126 | TGG | + | ACAUUGCAUAAAUCUAAGAU | 4220 |
| GGGAGCCCAGACAGGCTGGA | 1127 | TGG | - | GGGAGCCCAGACAGGCUGGA | 4221 |
| AAACATAAATCCCGAGAGGT | 1128 | TGG | + | AAACAUAAAUCCCGAGAGGU | 4222 |
| TCTACCTCCTGCCCACCTCT | 1129 | CGG | - | UCUACCUCCUGCCCACCUCU | 4223 |
| GGCCATCAACCGGCGGAACG | 1130 | AGG | + | GGCCAUCAACCGGCGGAACG | 4224 |
| AGGCGTTGAGAGGAGTGCGC | 1131 | CGG | + | AGGCGUUGAGAGGAGUGCGC | 4225 |
| TGTCCTGCCCTATACCCGGA | 1132 | GGG | - | UGUCCUGCCCUAUACCCGGA | 4226 |
| ATGCTTTGGTAAACATTTCT | 1133 | AGG | - | AUGCUUUGGUAAACAUUUCU | 4227 |
| GTGGGCCATGTGAGGCTTTG | 1134 | TGG | - | GUGGGCCAUGUGAGGCUUUG | 4228 |
| GGCGGGATAATCACTTGAGC | 1135 | TGG | - | GGCGGGAUAAUCACUUGAGC | 4229 |
| CTGGTGACAATATAATTCCA | 1136 | AGG | + | CUGGUGACAAUAUAAUUCCA | 4230 |
| GGCCAGCTTCAGGAGGGAGG | 1137 | GGG | + | GGCCAGCUUCAGGAGGGAGG | 4231 |
| TAGGACTGGGCCTTCTGAAA | 1138 | TGG | - | UAGGACUGGGCCUUCUGAAA | 4232 |
| TCCCTTGCATGCCCTGAGAT | 1139 | GGG | + | UCCCUUGCAUGCCCUGAGAU | 4233 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| GTCCCCTTGTCCCCATCTCA | 1140 | GGG | - | GUCCCCUUGUCCCCAUCUCA | 4234 |
| TGTGTGATATTCCTTCCCTC | 1141 | CGG | + | UGUGUGAUAUUCCUUCCCUC | 4235 |
| CTGCCCTATACCCGGAGGGA | 1142 | AGG | - | CUGCCCUAUACCCGGAGGGA | 4236 |
| CTTAAAATCCAACAGAAAAC | 1143 | AGG | + | CUUAAAAUCCAACAGAAAAC | 4237 |
| ACATAGGAAGCCAGGTGCGG | 1144 | TGG | - | ACAUAGGAAGCCAGGUGCGG | 4238 |
| GTGGCAGTGGAAGTGTTAAG | 1145 | TGG | - | GUGGCAGUGGAAGUGUUAAG | 4239 |
| CCCTTGCATGCCCTGAGATG | 1146 | GGG | + | CCCUUGCAUGCCCUGAGAUG | 4240 |
| GGTCCCCTTGTCCCCATCTC | 1147 | AGG | - | GGUCCCCUUGUCCCCAUCUC | 4241 |
| ATAAATCCCGAGAGGTGGGC | 1148 | AGG | + | AUAAAUCCCGAGAGGUGGGC | 4242 |
| TATGAGCATTTCCAGTTTGG | 1149 | GGG | + | UAUGAGCAUUUCCAGUUUGG | 4243 |
| TATTTGTAATACCCCCAAAC | 1150 | TGG | - | UAUUUGUAAUACCCCCAAAC | 4244 |
| GCCCAGGAGAGACAGCAGTG | 1151 | TGG | + | GCCCAGGAGAGACAGCAGUG | 4245 |
| TCACTTTTTAAATAGCAAAG | 1152 | TGG | + | UCACUUUUUAAAUAGCAAAG | 4246 |
| TCTGTGCTCTGCAAATGACC | 1153 | TGG | + | UCUGUGCUCUGCAAAUGACC | 4247 |
| AGGTCATTCTGCAAACCCCA | 1154 | AGG | + | AGGUCAUUCUGCAAACCCCA | 4248 |
| TAGGTTTGTCTATAATGTAC | 1155 | AGG | - | UAGGUUUGUCUAUAAUGUAC | 4249 |
| ACCTTCTCAAGTAGCAATGA | 1156 | AGG | - | ACCUUCUCAAGUAGCAAUGA | 4250 |
| GTATGGGTTTCTATAATCTG | 1157 | TGG | + | GUAUGGGUUUCUAUAAUCUG | 4251 |
| TACCAATCTTTGTGCATGGC | 1158 | TGG | + | UACCAAUCUUUGUGCAUGGC | 4252 |
| GACGTGCAGAAGGCGTTGAG | 1159 | AGG | + | GACGUGCAGAAGGCGUUGAG | 4253 |
| CTCACTTATCTCAAGGTTCA | 1160 | TGG | + | CUCACUUAUCUCAAGGUUCA | 4254 |
| TTCAGGAGAGAAAGGGTCAA | 1161 | GGG | + | UUCAGGAGAGAAAGGGUCAA | 4255 |
| TAGGACTTCTTCGCATCGCG | 1162 | GGG | - | UAGGACUUCUUCGCAUCGCG | 4256 |
| CTGCTCTTCGTGGACATTTC | 1163 | TGG | - | CUGCUCUUCGUGGACAUUUC | 4257 |
| AGAAATAGAGAAAAGAGGCC | 1164 | AGG | + | AGAAAUAGAGAAAAGAGGCC | 4258 |
| ACTGGTTACTCACCCGCTAT | 1165 | GGG | - | ACUGGUUACUCACCCGCUAU | 4259 |
| AGGACTTCTTCGCATCGCGG | 1166 | GGG | - | AGGACUUCUUCGCAUCGCGG | 4260 |
| CAACACGAATCTGAACAAAC | 1167 | AGG | - | CAACACGAAUCUGAACAAAC | 4261 |
| AGAAGTGATATGCTTCAATT | 1168 | AGG | + | AGAAGUGAUAUGCUUCAAUU | 4262 |
| GATAATCACTTGAGCTGGGG | 1169 | AGG | - | GAUAAUCACUUGAGCUGGGG | 4263 |
| ATATGAGCATTTCCAGTTTG | 1170 | GGG | + | AUAUGAGCAUUUCCAGUUUG | 4264 |
| CGGGATAATCACTTGAGCTG | 1171 | GGG | - | CGGGAUAAUCACUUGAGCUG | 4265 |
| CGGGAGAATCGTCTGATTGC | 1172 | TGG | + | CGGGAGAAUCGUCUGAUUGC | 4266 |
| TCACCAAAGGAGAAGCAACA | 1173 | TGG | - | UCACCAAAGGAGAAGCAACA | 4267 |
| GGGGAGGAGGATGATCTGTT | 1174 | TGG | - | GGGGAGGAGGAUGAUCUGUU | 4268 |
| CGTTGGATGAAGGTTCATTT | 1175 | CGG | + | CGUUGGAUGAAGGUUCAUUU | 4269 |
| AGGTCAATTCTGCCCATAGC | 1176 | GGG | + | AGGUCAAUUCUGCCCAUAGC | 4270 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| ATGGCCAGCTTCAGGAGGGA | 1177 | GGG | + | AUGGCCAGCUUCAGGAGGGA | 4271 |
| AAATTTATTTCGTACAATAC | 1178 | TGG | + | AAAUUUAUUUCGUACAAUAC | 4272 |
| GAAGAGCGCACGATAGACGC | 1179 | CGG | + | GAAGAGCGCACGAUAGACGC | 4273 |
| CCACTGCTTCTGTCCTTCAG | 1180 | TGG | + | CCACUGCUUCUGUCCUUCAG | 4274 |
| CAAAGAAATTCTATGGACGG | 1181 | AGG | + | CAAAGAAAUUCUAUGGACGG | 4275 |
| AAGGATGAGGTCGGGTGCAG | 1182 | TGG | + | AAGGAUGAGGUCGGGUGCAG | 4276 |
| GATCAAAGGGTATGATCTAA | 1183 | TGG | + | GAUCAAAGGGUAUGAUCUAA | 4277 |
| TTTTGTGTCCACTGTAGGCT | 1184 | TGG | - | UUUUGUGUCCACUGUAGGCU | 4278 |
| AGGGAAGGAATATCACACAG | 1185 | GGG | - | AGGGAAGGAAUAUCACACAG | 4279 |
| CTAGGACTTCTTCGCATCGC | 1186 | GGG | - | CUAGGACUUCUUCGCAUCGC | 4280 |
| ACCAATCTTTGTGCATGGCT | 1187 | GGG | + | ACCAAUCUUUGUGCAUGGCU | 4281 |
| TTGGCGACAACATATTGTAA | 1188 | TGG | - | UUGGCGACAACAUAUUGUAA | 4282 |
| TGGCCAGCTTCAGGAGGGAG | 1189 | GGG | + | UGGCCAGCUUCAGGAGGGAG | 4283 |
| GGGAGGAGGATGATCTGTTT | 1190 | GGG | - | GGGAGGAGGAUGAUCUGUUU | 4284 |
| TAGGGAAGCCCTCACTGAGA | 1191 | AGG | - | UAGGGAAGCCCUCACUGAGA | 4285 |
| AAGGTCAATTCTGCCCATAG | 1192 | CGG | + | AAGGUCAAUUCUGCCCAUAG | 4286 |
| ATCTAATTGTGGCACAGTGA | 1193 | GGG | + | AUCUAAUUGUGGCACAGUGA | 4287 |
| TACTGGAGGGGGCAGCGCG | 1194 | TGG | + | UACUGGAGGGGGCAGCGCG | 4288 |
| CATCTAATTGTGGCACAGTG | 1195 | AGG | + | CAUCUAAUUGUGGCACAGUG | 4289 |
| GCTCTGAAGCACTTGAAATG | 1196 | TGG | + | GCUCUGAAGCACUUGAAAUG | 4290 |
| CTATGTCTTATAATTGAGTC | 1197 | AGG | + | CUAUGUCUUAUAAUUGAGUC | 4291 |
| TTTATTTCGTACAATACTGG | 1198 | AGG | + | UUUAUUUCGUACAAUACUGG | 4292 |
| AATCCCGAGAGGTGGGCAGG | 1199 | AGG | + | AAUCCCGAGAGGUGGGCAGG | 4293 |
| GTATAGCGCCAAGCCTACAG | 1200 | TGG | + | GUAUAGCGCCAAGCCUACAG | 4294 |
| AACCGGAATGCTATTGACGG | 1201 | TGG | + | AACCGGAAUGCUAUUGACGG | 4295 |
| TTGTTTTGTTCAAAATGTCT | 1202 | GGG | + | UUGUUUUGUUCAAAAUGUCU | 4296 |
| TCTAGGACTTCTTCGCATCG | 1203 | CGG | - | UCUAGGACUUCUUCGCAUCG | 4297 |
| CCTAGTTTAGTCTCTTGGAT | 1204 | TGG | - | CCUAGUUUAGUCUCUUGGAU | 4298 |
| TTTAAATTCCAATACCACAT | 1205 | GGG | + | UUUAAAUUCCAAUACCACAU | 4299 |
| AGCATCCTTTGAACTTTAGA | 1206 | AGG | - | AGCAUCCUUUGAACUUUAGA | 4300 |
| GCGGGATAATCACTTGAGCT | 1207 | GGG | - | GCGGGAUAAUCACUUGAGCU | 4301 |
| ACTCTGTAACACACGCCTGC | 1208 | TGG | + | ACUCUGUAACACACGCCUGC | 4302 |
| AAGCGTTTTGCGCAGGAGAG | 1209 | TGG | + | AAGCGUUUUGCGCAGGAGAG | 4303 |
| AGAGCTTTGGCCGAGGACGA | 1210 |  | + | AGAGCUUUGGCCGAGGACGA | 4304 |
| AGAGACAGAAAGTCGATCCG | 1211 | TGG | - | AGAGACAGAAAGUCGAUCCG | 4305 |
| CTATTAAAAGGATGAGGTC | 1212 | GGG | + | CUAUUAAAAGGAUGAGGUC | 4306 |
| TGAAGGACAGAAGCAGTGGA | 1213 | GGG | - | UGAAGGACAGAAGCAGUGGA | 4307 |
| CTGAAGGACAGAAGCAGTGG | 1214 | AGG | - | CUGAAGGACAGAAGCAGUGG | 4308 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TACCTTATTTCACTGTAATG | 1215 | AGG | - | UACCUUAUUUCACUGUAAUG | 4309 |
| AATTAGACCTGCCCAGTTAG | 1216 | TGG | + | AAUUAGACCUGCCCAGUUAG | 4310 |
| CTGATATCCACTAACTGGGC | 1217 | AGG | - | CUGAUAUCCACUAACUGGGC | 4311 |
| ATTGCTGATATCCACTAACT | 1218 | GGG | - | AUUGCUGAUAUCCACUAACU | 4312 |
| CAGGCTGTCAGGAGGCATGA | 1219 | AGG | + | CAGGCUGUCAGGAGGCAUGA | 4313 |
| AAATATCTTACTTCATTACT | 1220 | TGG | + | AAAUAUCUUACUUCAUUACU | 4314 |
| TTTTCTGGTATGATACTATT | 1221 | AGG | + | UUUUCUGGUAUGAUACUAUU | 4315 |
| CTGGTATGATACTATTAGGT | 1222 | TGG | + | CUGGUAUGAUACUAUUAGGU | 4316 |
| ATCTCTTGATGAACAGCTAC | 1223 | AGG | + | AUCUCUUGAUGAACAGCUAC | 4317 |
| GATGAACAGCTACAGGCCTG | 1224 | AGG | + | GAUGAACAGCUACAGGCCUG | 4318 |
| ACAGCTACAGGCCTGAGGTT | 1225 | AGG | + | ACAGCUACAGGCCUGAGGUU | 4319 |
| CTACATGAACTCCTAACCTC | 1226 | AGG | - | CUACAUGAACUCCUAACCUC | 4320 |
| GTCCTTCAGCCTCAACTTAT | 1227 | AGG | + | GUCCUUCAGCCUCAACUUAU | 4321 |
| CACCTATAAGTTGAGGCTGA | 1228 | AGG | - | CACCUAUAAGUUGAGGCUGA | 4322 |
| ACACAGTCACCTATAAGTTG | 1229 | AGG | - | ACACAGUCACCUAUAAGUUG | 4323 |
| TCGTTAACTCCGCAGAGCAC | 1230 | AGG | + | UCGUUAACUCCGCAGAGCAC | 4324 |
| CGTTAACTCCGCAGAGCACA | 1231 | GGG | + | CGUUAACUCCGCAGAGCACA | 4325 |
| GGATGGTGCCCTGTGCTCTG | 1232 | CGG | - | GGAUGGUGCCCUGUGCUCUG | 4326 |
| CTATCCCCAGCACCTAAAGC | 1233 | TGG | + | CUAUCCCCAGCACCUAAAGC | 4327 |
| TATCCCCAGCACCTAAAGCT | 1234 | GGG | + | UAUCCCCAGCACCUAAAGCU | 4328 |
| GGTAGGGATTTAGGAAAAAG | 1235 | AGG | + | GGUAGGGAUUUAGGAAAAAG | 4329 |
| AGGGATTTAGGAAAAAGAGG | 1236 | AGG | + | AGGGAUUUAGGAAAAAGAGG | 4330 |
| TTTAGGAAAAAGAGGAGGCT | 1237 | TGG | + | UUUAGGAAAAAGAGGAGGCU | 4331 |
| AGGAAAAAGAGGAGGCTTGG | 1238 | AGG | + | AGGAAAAAGAGGAGGCUUGG | 4332 |
| GATCATCTAGCACATGTTTT | 1239 | TGG | + | GAUCAUCUAGCACAUGUUUU | 4333 |
| CTAGCACATGTTTTTGGTTT | 1240 | TGG | + | CUAGCACAUGUUUUUGGUUU | 4334 |
| TATCTGGTGGGTAGCTACTT | 1241 | AGG | + | UAUCUGGUGGGUAGCUACUU | 4335 |
| GGTGGGTAGCTACTTAGGAG | 1242 | TGG | + | GGUGGGUAGCUACUUAGGAG | 4336 |
| CCTGCTTCCTGCTTCATCCC | 1243 | TGG | + | CCUGCUUCCUGCUUCAUCCC | 4337 |
| GAAGGTGCCAGGGATGAAGC | 1244 | AGG | - | GAAGGUGCCAGGGAUGAAGC | 4338 |
| TTGCCCCTTCCGCCATGGGA | 1245 | GGG | - | UUGCCCCUUCCGCCAUGGGA | 4339 |
| CTTGCCCCTTCCGCCATGGG | 1246 | AGG | - | CUUGCCCCUUCCGCCAUGGG | 4340 |
| TAGCTTGCCCCTTCCGCCAT | 1247 | GGG | - | UAGCUUGCCCCUUCCGCCAU | 4341 |
| CTAGCTTGCCCCTTCCGCCA | 1248 | TGG | - | CUAGCUUGCCCCUUCCGCCA | 4342 |
| ACTAACATTCACATCATAGC | 1249 | AGG | + | ACUAACAUUCACAUCAUAGC | 4343 |
| CTAACATTCACATCATAGCA | 1250 | GGG | + | CUAACAUUCACAUCAUAGCA | 4344 |
| TCACATCATAGCAGGGACTC | 1251 | TGG | + | UCACAUCAUAGCAGGGACUC | 4345 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CATCATAGCAGGGACTCTGG | 1252 | TGG | + | CAUCAUAGCAGGGACUCUGG | 4346 |
| GGGAGCGCCATCTTTGTAGC | 1253 | AGG | - | GGGAGCGCCAUCUUUGUAGC | 4347 |
| TCAAGTAGCAATGAAGGTTA | 1254 | GGG | - | UCAAGUAGCAAUGAAGGUUA | 4348 |
| CTCAAGTAGCAATGAAGGTT | 1255 | AGG | - | CUCAAGUAGCAAUGAAGGUU | 4349 |
| GGAAGACCTGTGCATTTTTG | 1256 | TGG | + | GGAAGACCUGUGCAUUUUUG | 4350 |
| AACTGTCCACAAAAATGCAC | 1257 | AGG | - | AACUGUCCACAAAAAUGCAC | 4351 |
| ATTTATTTTTAGCAGAGACA | 1258 | GGG | + | AUUUAUUUUUAGCAGAGACA | 4352 |
| GGTTGGTGCAAGAGTAACTG | 1259 | CGG | + | GGUUGGUGCAAGAGUAACUG | 4353 |
| ATATCGGCTCACTGCAACCC | 1260 | GGG | + | AUAUCGGCUCACUGCAACCC | 4354 |
| AGCCAGCATCTTCTCTCCCT | 1261 | CGG | + | AGCCAGCAUCUUCUCUCCCU | 4355 |
| CACCTGTGATCCGAGCTACT | 1262 | TGG | - | CACCUGUGAUCCGAGCUACU | 4356 |
| TACTCGGGGAGGCTGAAGC | 1263 | GGG | + | UACUCGGGGAGGCUGAAGC | 4357 |
| GAACGAGGTGGAGTTTGGCC | 1264 | AGG | + | GAACGAGGUGGAGUUUGGCC | 4358 |
| GCATCACTGCACCTCAGTCT | 1265 | GGG | - | GCAUCACUGCACCUCAGUCU | 4359 |
| TGGGTTTTGCCATATTGCTC | 1266 | AGG | - | UGGGUUUUGCCAUAUUGCUC | 4360 |
| CTACTTAGGAGTGGAATTGC | 1267 | TGG | + | CUACUUAGGAGUGGAAUUGC | 4361 |
| TTCAGCCTCCCCCGAGTAGC | 1268 | TGG | - | UUCAGCCUCCCCCGAGUAGC | 4362 |
| CACTTCCACTGCCACCACCC | 1269 | TGG | + | CACUUCCACUGCCACCACCC | 4363 |
| TGCATCACTGCACCTCAGTC | 1270 | TGG | - | UGCAUCACUGCACCUCAGUC | 4364 |
| TCCACAGCCTTGTCAACACT | 1271 | AGG | + | UCCACAGCCUUGUCAACACU | 4365 |
| CTCTGGGGAGCATACAGAC | 1272 | GGG | - | CUCUGGGGAGCAUACAGAC | 4366 |
| TCCCCCAGAGGTTTGAGCAG | 1273 | CGG | + | UCCCCCAGAGGUUUGAGCAG | 4367 |
| AGGGAGAGAAGATGCTGGCT | 1274 | TGG | - | AGGGAGAGAAGAUGCUGGCU | 4368 |
| TCTTAGCCTAGGAAGATTCA | 1275 | GGG | - | UCUUAGCCUAGGAAGAUUCA | 4369 |
| GTATCTCAGGGTTCTTGCCT | 1276 | TGG | - | GUAUCUCAGGGUUCUUGCCU | 4370 |
| CTCAAGTGGTTTGCCCGCCT | 1277 | CGG | + | CUCAAGUGGUUUGCCCGCCU | 4371 |
| CAAAACCAGCCTGAGCAATA | 1278 | TGG | + | CAAAACCAGCCUGAGCAAUA | 4372 |
| TGAGGCGGGTCTATCACCTG | 1279 | AGG | + | UGAGGCGGGUCUAUCACCUG | 4373 |
| TGCCCAGGGGCTGGGGAGG | 1280 | GGG | - | UGCCCAGGGGCUGGGGAGG | 4374 |
| CAGCCATGAGCCACTGCGTC | 1281 | CGG | + | CAGCCAUGAGCCACUGCGUC | 4375 |
| TAAGATGTGGGCCTTTGGG | 1282 | AGG | - | UAAGAUGUGGGCCUUUGGG | 4376 |
| CAAAAAGTATCTGGGCATGA | 1283 | TGG | + | CAAAAAGUAUCUGGGCAUGA | 4377 |
| TTAAATTAATTAAAATTGGC | 1284 | CGG | - | UUAAAUUAAUUAAAAUUGGC | 4378 |
| TGGAAGTGAGCAGAGAGAGA | 1285 | AGG | - | UGGAAGUGAGCAGAGAGAGA | 4379 |
| CCGTCTGTATGCTCCCCCAG | 1286 | AGG | + | CCGUCUGUAUGCUCCCCCAG | 4380 |
| CAGCATTTGGGCACGAAGGC | 1287 | AGG | - | CAGCAUUUGGGCACGAAGGC | 4381 |
| CATGCCCTGAGATGGGACA | 1288 | AGG | + | CAUGCCCUGAGAUGGGACA | 4382 |
| ACTTCCACTGCCACCACCCT | 1289 | GGG | + | ACUUCCACUGCCACCACCCU | 4383 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TTTACAGCTGAGGCCCCAGC | 1290 | AGG | - | UUUACAGCUGAGGCCCCAGC | 4384 |
| ATGCCCTGAGATGGGGACAA | 1291 | GGG | + | AUGCCCUGAGAUGGGGACAA | 4385 |
| TTGAATGAATGAATGCTTTG | 1292 | AGG | + | UUGAAUGAAUGAAUGCUUUG | 4386 |
| AATGCAGCATTTGGGCACGA | 1293 | AGG | - | AAUGCAGCAUUUGGGCACGA | 4387 |
| TAAAATTACAAAAATGATCC | 1294 | GGG | - | UAAAAUUACAAAAAUGAUCC | 4388 |
| GGAAGGAGCTCTCAGCAGAT | 1295 | AGG | - | GGAAGGAGCUCUCAGCAGAU | 4389 |
| AAGTATCTGGGCATGATGGC | 1296 | AGG | + | AAGUAUCUGGGCAUGAUGGC | 4390 |
| TGCCCCGCTGCTCAAACCTC | 1297 | TGG | - | UGCCCCGCUGCUCAAACCUC | 4391 |
| TGCAGCTATTAAAAAGGATG | 1298 | AGG | + | UGCAGCUAUUAAAAAGGAUG | 4392 |
| ACGCCACTGTACTCCCAGCC | 1299 | TGG | - | ACGCCACUGUACUCCCAGCC | 4393 |
| TATTGTATTTCTTGTAGAGA | 1300 | GGG | + | UAUUGUAUUUCUUGUAGAGA | 4394 |
| TGAGTCTCGCTCAGTCACCC | 1301 | AGG | - | UGAGUCUCGCUCAGUCACCC | 4395 |
| TTGGCGGAAGAAGACACAAG | 1302 | TGG | + | UUGGCGGAAGAAGACACAAG | 4396 |
| CCGAGCTACTTGGAAGACTG | 1303 | AGG | - | CCGAGCUACUUGGAAGACUG | 4397 |
| AAGGAGCTCTCAGCAGATAG | 1304 | GGG | - | AAGGAGCUCUCAGCAGAUAG | 4398 |
| TGAAGCACTTGAAATGTGGC | 1305 | TGG | + | UGAAGCACUUGAAAUGUGGC | 4399 |
| GAAGGAGCTCTCAGCAGATA | 1306 | GGG | - | GAAGGAGCUCUCAGCAGAUA | 4400 |
| GGAGGGAAGGAATATCACAC | 1307 | AGG | - | GGAGGGAAGGAAUAUCACAC | 4401 |
| GAGGGAAGGAATATCACACA | 1308 | GGG | - | GAGGGAAGGAAUAUCACACA | 4402 |
| TGGCCGGACGCAGTGGCTCA | 1309 | TGG | - | UGGCCGGACGCAGUGGCUCA | 4403 |
| CGGGTCTATCACCTGAGGTC | 1310 | AGG | + | CGGGUCUAUCACCUGAGGUC | 4404 |
| TGGCTGTAATTCTAACACTT | 1311 | TGG | - | UGGCUGUAAUUCUAACACUU | 4405 |
| GGCTGTAATTCTAACACTTT | 1312 | GGG | - | GGCUGUAAUUCUAACACUUU | 4406 |
| GGCTTGAGCCCTGGAGTTCA | 1313 | AGG | + | GGCUUGAGCCCUGGAGUUCA | 4407 |
| CCTCTGGGGAGCATACAGA | 1314 | CGG | - | CCUCUGGGGAGCAUACAGA | 4408 |
| GGGGGAGCATACAGACGGGC | 1315 | AGG | - | GGGGGAGCAUACAGACGGGC | 4409 |
| AGGGTCTCGCCATGCTGCCC | 1316 | AGG | + | AGGGUCUCGCCAUGCUGCCC | 4410 |
| ATGAGCCACTGCGTCCGGCC | 1317 | AGG | + | AUGAGCCACUGCGUCCGGCC | 4411 |
| GAGGAGAATCGATTGAACCC | 1318 | AGG | - | GAGGAGAAUCGAUUGAACCC | 4412 |
| CAAGGCAGGAGTATCACCTG | 1319 | AGG | + | CAAGGCAGGAGUAUCACCUG | 4413 |
| ACAAAAGGGGCCGGGCGCGG | 1320 | TGG | - | ACAAAAGGGGCCGGGCGCGG | 4414 |
| AAAAAGGATGAGTTCATGTA | 1321 | GGG | + | AAAAAGGAUGAGUUCAUGUA | 4415 |
| CTGTCGTGGGTGGGGAGC | 1322 | GGG | + | CUGUCGUGGGUGGGGAGC | 4416 |
| CGCCACTGTACTCCCAGCCT | 1323 | GGG | - | CGCCACUGUACUCCCAGCCU | 4417 |
| TGCCCAGGCTGGGAGTACAG | 1324 | TGG | + | UGCCCAGGCUGGGAGUACAG | 4418 |
| CAAAAATACAAAAGTATCT | 1325 | GGG | + | CAAAAAUACAAAAGUAUCU | 4419 |
| ACAAAAATACAAAAGTATC | 1326 | TGG | + | ACAAAAAUACAAAAGUAUC | 4420 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CGGGCAAACCACTTGAGGTC | 1327 | AGG | - | CGGGCAAACCACUUGAGGUC | 4421 |
| TTGTATCTTTAGTAGAGCCA | 1328 | GGG | + | UUGUAUCUUUAGUAGAGCCA | 4422 |
| AATAAATTAGCCGGATGTGG | 1329 | TGG | - | AAUAAAUUAGCCGGAUGUGG | 4423 |
| GAGACAGGGTTTCAGCATGC | 1330 | TGG | + | GAGACAGGGUUUCAGCAUGC | 4424 |
| CCCCCAGAGGTTTGAGCAGC | 1331 | GGG | + | CCCCCAGAGGUUUGAGCAGC | 4425 |
| AAAAAAGGATGAGTTCATGT | 1332 | AGG | + | AAAAAAGGAUGAGUUCAUGU | 4426 |
| AGCACCACTGCACTCCAGTG | 1333 | TGG | + | AGCACCACUGCACUCCAGUG | 4427 |
| CAGGTGTCCTGCCCTATACC | 1334 | CGG | - | CAGGUGUCCUGCCCUAUACC | 4428 |
| GCTTGTAGTCCCAGCTACCA | 1335 | TGG | + | GCUUGUAGUCCCAGCUACCA | 4429 |
| GATGAGTTCATGTAGGGACA | 1336 | TGG | + | GAUGAGUUCAUGUAGGGACA | 4430 |
| CCATGGGAGGCTGAGGTGAG | 1337 | AGG | + | CCAUGGGAGGCUGAGGUGAG | 4431 |
| TATTTATTTTAGCAGAGAC | 1338 | AGG | + | UAUUUAUUUUAGCAGAGAC | 4432 |
| TTTGTATCTTTAGTAGAGCC | 1339 | AGG | + | UUUGUAUCUUUAGUAGAGCC | 4433 |
| AGACGGGGTTTCACCAGGTT | 1340 | GGG | - | AGACGGGGUUUCACCAGGUU | 4434 |
| GGGCTTGCAGAATGAGTGCA | 1341 | AGG | - | GGGCUUGCAGAAUGAGUGCA | 4435 |
| GGCCTGCTTCAGGGAAGAAG | 1342 | AGG | + | GGCCUGCUUCAGGGAAGAAG | 4436 |
| AGGGTTTCAGCATGCTGGCC | 1343 | AGG | + | AGGGUUUCAGCAUGCUGGCC | 4437 |
| TGAGACCAGCCTGCCCAACC | 1344 | TGG | + | UGAGACCAGCCUGCCCAACC | 4438 |
| CAGGCATGAGCTACCCCGCC | 1345 | CGG | + | CAGGCAUGAGCUACCCCGCC | 4439 |
| AAAAAAAAAAAAACAAGTCT | 1346 | GGG | + | AAAAAAAAAAAAACAAGUCU | 4440 |
| ATAAAATACCATAAACTAGG | 1347 | TGG | + | AUAAAAUACCAUAAACUAGG | 4441 |
| GCCGGTAATCCCAGTTACTC | 1348 | AGG | + | GCCGGUAAUCCCAGUUACUC | 4442 |
| TGTTAATTTTTTGTAGAGA | 1349 | CGG | - | UGUUAAUUUUUUGUAGAGA | 4443 |
| CTCAAACTTCTGAGCTCAAG | 1350 | GGG | + | CUCAAACUUCUGAGCUCAAG | 4444 |
| ATACTATGCAGCTATTAAAA | 1351 | AGG | + | AUACUAUGCAGCUAUUAAAA | 4445 |
| AGAAAAGAGGCCAGGTGCAG | 1352 | GGG | + | AGAAAAGAGGCCAGGUGCAG | 4446 |
| GTTAATTTTTTGTAGAGAC | 1353 | GGG | - | GUUAAUUUUUUGUAGAGAC | 4447 |
| CTTCAGGAGGCCAAGGCCAG | 1354 | AGG | + | CUUCAGGAGGCCAAGGCCAG | 4448 |
| CAAAAATGATCCGGGCGTGG | 1355 | TGG | - | CAAAAAUGAUCCGGGCGUGG | 4449 |
| GCACAGGATGGGGCGTGGT | 1356 | GGG | - | GCACAGGAUGGGGCGUGGU | 4450 |
| GGTCTGGAACTCTCGACCTC | 1357 | AGG | - | GGUCUGGAACUCUCGACCUC | 4451 |
| TGCCAAATAGTTTTCCAAAG | 1358 | AGG | + | UGCCAAAUAGUUUUCCAAAG | 4452 |
| CCTGTCACATGAGGGTCTTC | 1359 | AGG | + | CCUGUCACAUGAGGGUCUUC | 4453 |
| CCTCTAATCCCAGCTACTCG | 1360 | GGG | + | CCUCUAAUCCCAGCUACUCG | 4454 |
| GGCTGGGAAGTCCACGATCA | 1361 | AGG | + | GGCUGGGAAGUCCACGAUCA | 4455 |
| CCTGAAGACCCTCATGTGAC | 1362 | AGG | - | CCUGAAGACCCUCAUGUGAC | 4456 |
| CGGAAGAAGACACAAGTGGC | 1363 | TGG | + | CGGAAGAAGACACAAGUGGC | 4457 |
| GCAGGACACCTGTCACATGA | 1364 | GGG | + | GCAGGACACCUGUCACAUGA | 4458 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TGTCACATGAGGGTCTTCAG | 1365 | GGG | + | UGUCACAUGAGGGUCUUCAG | 4459 |
| CAGCAGATAGGGGAGCCAGA | 1366 | AGG | - | CAGCAGAUAGGGGAGCCAGA | 4460 |
| GGGTTTTCACCATGTTTCCC | 1367 | AGG | + | GGGUUUUCACCAUGUUUCCC | 4461 |
| CCCCGAGTAGCTGGGATTAG | 1368 | AGG | - | CCCCGAGUAGCUGGGAUUAG | 4462 |
| CACTTGAGCTGGGGAGGCGG | 1369 | AGG | - | CACUUGAGCUGGGGAGGCGG | 4463 |
| ATCAAGGTGCCAGCAGATTT | 1370 | GGG | + | AUCAAGGUGCCAGCAGAUUU | 4464 |
| CTGTCACATGAGGGTCTTCA | 1371 | GGG | + | CUGUCACAUGAGGGUCUUCA | 4465 |
| GTCCGTGGGCACAGGCCTGG | 1372 | GGG | - | GUCCGUGGGCACAGGCCUGG | 4466 |
| GGCAGGACACCTGTCACATG | 1373 | AGG | + | GGCAGGACACCUGUCACAUG | 4467 |
| AGCAGATAGGGGAGCCAGAA | 1374 | GGG | - | AGCAGAUAGGGGAGCCAGAA | 4468 |
| CGCTTGTGTGTCTGCCTGCT | 1375 | AGG | - | CGCUUGUGUGUCUGCCUGCU | 4469 |
| CCGGCATGCGCCACCATGCC | 1376 | TGG | - | CCGGCAUGCGCCACCAUGCC | 4470 |
| CCAGACCAGCCTGGCCAAGG | 1377 | TGG | - | CCAGACCAGCCUGGCCAAGG | 4471 |
| CGTGGGCACAGGCCTGGGGG | 1378 | TGG | - | CGUGGGCACAGGCCUGGGGG | 4472 |
| AGAAAACTGCAGAAGCAGGA | 1379 | AGG | - | AGAAAACUGCAGAAGCAGGA | 4473 |
| CTCTAATCCCAGCTACTCGG | 1380 | GGG | + | CUCUAAUCCCAGCUACUCGG | 4474 |
| GGATGGGGCGTGGTGGGCC | 1381 | AGG | - | GGAUGGGGCGUGGUGGGCC | 4475 |
| CTCAGGTGATACTCCTGCCT | 1382 | TGG | - | CUCAGGUGAUACUCCUGCCU | 4476 |
| CCACCTTGGCCAGGCTGGTC | 1383 | TGG | + | CCACCUUGGCCAGGCUGGUC | 4477 |
| GTCTTGGGAAATGCAGCATT | 1384 | TGG | - | GUCUUGGGAAAUGCAGCAUU | 4478 |
| CCAGGCATGGTGGCGCATGC | 1385 | CGG | + | CCAGGCAUGGUGGCGCAUGC | 4479 |
| CGGAAGAATCAGATCACACG | 1386 | TGG | - | CGGAAGAAUCAGAUCACACG | 4480 |
| GGGGTTTCACCAGGTTGGGC | 1387 | AGG | - | GGGGUUUCACCAGGUUGGGC | 4481 |
| TCACTGATGGACGTTTGGGT | 1388 | TGG | - | UCACUGAUGGACGUUUGGGU | 4482 |
| AACGTCCATCAGTGATAGAC | 1389 | TGG | + | AACGUCCAUCAGUGAUAGAC | 4483 |
| TCTATCACTGATGGACGTTT | 1390 | GGG | - | UCUAUCACUGAUGGACGUUU | 4484 |
| GATGGGGCGTGGTGGGCCA | 1391 | GGG | - | GAUGGGGCGUGGUGGGCCA | 4485 |
| GCGAGGAACATCACACACTG | 1392 | GGG | + | GCGAGGAACAUCACACACUG | 4486 |
| AATCACTTGAGCTGGGGAGG | 1393 | CGG | - | AAUCACUUGAGCUGGGGAGG | 4487 |
| CAGGAGTATCACCTGAGGTC | 1394 | AGG | + | CAGGAGUAUCACCUGAGGUC | 4488 |
| GTGGGGTGGGGAGCGGGGA | 1395 | GGG | + | GUGGGGUGGGGAGCGGGGA | 4489 |
| TTTCACCAGGTTGGGCAGGC | 1396 | TGG | - | UUUCACCAGGUUGGGCAGGC | 4490 |
| TCTTGGGAAATGCAGCATTT | 1397 | GGG | - | UCUUGGGAAAUGCAGCAUUU | 4491 |
| GTTCCAGACCAGCCTGGCCA | 1398 | AGG | - | GUUCCAGACCAGCCUGGCCA | 4492 |
| TCTCGCCATGCTGCCCAGGC | 1399 | TGG | + | UCUCGCCAUGCUGCCCAGGC | 4493 |
| TTTCAGCATGCTGGCCAGGC | 1400 | TGG | + | UUUCAGCAUGCUGGCCAGGC | 4494 |
| GGGGGCGTGGTGGGCCAGGG | 1401 | TGG | - | GGGGGCGUGGUGGGCCAGGG | 4495 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| GTCTATCACTGATGGACGTT | 1402 | TGG | - | GUCUAUCACUGAUGGACGUU | 4496 |
| TAACACAAGCCGCCTACAGA | 1403 | CGG | + | UAACACAAGCCGCCUACAGA | 4497 |
| AATAGCTGCATAGTATTCCA | 1404 | TGG | - | AAUAGCUGCAUAGUAUUCCA | 4498 |
| TCCTGCCTCAGGCTCCCGAG | 1405 | TGG | + | UCCUGCCUCAGGCUCCCGAG | 4499 |
| CTAGCAGGCAGACACACAAG | 1406 | CGG | + | CUAGCAGGCAGACACACAAG | 4500 |
| GCCACTCGGGAGCCTGAGGC | 1407 | AGG | - | GCCACUCGGGAGCCUGAGGC | 4501 |
| AGGTCCGTGGGCACAGGCCT | 1408 | GGG | - | AGGUCCGUGGGCACAGGCCU | 4502 |
| GCCTCAGGCTCCCGAGTGGC | 1409 | TGG | + | GCCUCAGGCUCCCGAGUGGC | 4503 |
| CCCAGCCACTCGGGAGCCTG | 1410 | AGG | - | CCCAGCCACUCGGGAGCCUG | 4504 |
| TGTAGAGACGGGGTTTCACC | 1411 | AGG | - | UGUAGAGACGGGGUUUCACC | 4505 |
| ACTGCCACTGTACTCCAGCC | 1412 | TGG | + | ACUGCCACUGUACUCCAGCC | 4506 |
| TCTCAAACTTCTGAGCTCAA | 1413 | GGG | + | UCUCAAACUUCUGAGCUCAA | 4507 |
| GTCTCAAACTTCTGAGCTCA | 1414 | AGG | + | GUCUCAAACUUCUGAGCUCA | 4508 |
| CCTCAGGCTCCCGAGTGGCT | 1415 | GGG | + | CCUCAGGCUCCCGAGUGGCU | 4509 |
| AGGCCTGTGCCCACGGACCT | 1416 | AGG | + | AGGCCUGUGCCCACGGACCU | 4510 |
| ACCTGTAATCCCAGCCACCT | 1417 | GGG | - | ACCUGUAAUCCCAGCCACCU | 4511 |
| AGAGTCTCGCTGTGTTGCTC | 1418 | AGG | + | AGAGUCUCGCUGUGUUGCUC | 4512 |
| TAGGTCCGTGGGCACAGGCC | 1419 | TGG | - | UAGGUCCGUGGGCACAGGCC | 4513 |
| CACCCCCAGGCCTGTGCCCA | 1420 | CGG | + | CACCCCCAGGCCUGUGCCCA | 4514 |
| TCAGCCTCCCCCGAGTAGCT | 1421 | GGG | - | UCAGCCUCCCCCGAGUAGCU | 4515 |
| GGCACAGGATGGGGCGTGG | 1422 | TGG | - | GGCACAGGAUGGGGCGUGG | 4516 |
| GCTTGTGTGTCTGCCTGCTA | 1423 | GGG | - | GCUUGUGUGUCUGCCUGCUA | 4517 |
| CCTCTCACCTCAGCCTCCCA | 1424 | TGG | - | CCUCUCACCUCAGCCUCCCA | 4518 |
| ATAATAAAATACCATAAACT | 1425 | AGG | + | AUAAUAAAAUACCAUAAACU | 4519 |
| CACCTGTAATCCCAGCCACC | 1426 | TGG | - | CACCUGUAAUCCCAGCCACC | 4520 |
| CGTCTGTAATCCCAGCCACT | 1427 | CGG | - | CGUCUGUAAUCCCAGCCACU | 4521 |
| AGGAGAATCACTTGAAACCC | 1428 | GGG | - | AGGAGAAUCACUUGAAACCC | 4522 |
| TAATCCCAGCTACTCGGGGG | 1429 | AGG | + | UAAUCCCAGCUACUCGGGGG | 4523 |
| GGGATTACAGCCACCATGCC | 1430 | TGG | - | GGGAUUACAGCCACCAUGCC | 4524 |
| CTGGAACTCCTGACCTCAAG | 1431 | TGG | + | CUGGAACUCCUGACCUCAAG | 4525 |
| TACTTAGGAGTGGAATTGCT | 1432 | GGG | + | UACUUAGGAGUGGAAUUGCU | 4526 |
| GGTCCGTGGGCACAGGCCTG | 1433 | GGG | - | GGUCCGUGGGCACAGGCCUG | 4527 |
| GAGCCACCATGCCCGGCCCA | 1434 | AGG | - | GAGCCACCAUGCCCGGCCCA | 4528 |
| CTTACTCTTGTCGCCCAGGC | 1435 | TGG | - | CUUACUCUUGUCGCCCAGGC | 4529 |
| CCTGTCGTGGGTGGGGAG | 1436 | CGG | + | CCUGUCGUGGGUGGGGAG | 4530 |
| AGGAGGTCGAGGCTGCAGTG | 1437 | AGG | + | AGGAGGUCGAGGCUGCAGUG | 4531 |
| GGAAGAATCAGATCACACGT | 1438 | GGG | - | GGAAGAAUCAGAUCACACGU | 4532 |
| ATACAGACGGGCAGGCTGTG | 1439 | GGG | - | AUACAGACGGGCAGGCUGUG | 4533 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| GAGTGGAATTGCTGGGTCAT | 1440 | AGG | + | GAGUGGAAUUGCUGGGUCAU | 4534 |
| GCCTGTCATCCCAGCTACTA | 1441 | GGG | - | GCCUGUCAUCCCAGCUACUA | 4535 |
| TTTATAAGCCACCTAGTTTA | 1442 | TGG | - | UUUAUAAGCCACCUAGUUUA | 4536 |
| GCATACAGACGGGCAGGCTG | 1443 | TGG | - | GCAUACAGACGGGCAGGCUG | 4537 |
| TGGTGGGCCAGGGTGGTCTT | 1444 | GGG | - | UGGUGGGCCAGGGUGGUCUU | 4538 |
| TCACTCTGTCACCCAGACTG | 1445 | AGG | + | UCACUCUGUCACCCAGACUG | 4539 |
| CATACAGACGGGCAGGCTGT | 1446 | GGG | - | CAUACAGACGGGCAGGCUGU | 4540 |
| AACTGAACAATGAAAACACT | 1447 | TGG | + | AACUGAACAAUGAAAACACU | 4541 |
| CTTACTCTGTTGCCCAGGCT | 1448 | GGG | + | CUUACUCUGUUGCCCAGGCU | 4542 |
| GGTTTTGAACTCCTGACCTT | 1449 | AGG | - | GGUUUUGAACUCCUGACCUU | 4543 |
| GTGGTGGGCCAGGGTGGTCT | 1450 | TGG | - | GUGGUGGGCCAGGGUGGUCU | 4544 |
| CAGGTGTGCACCACCATGGC | 1451 | CGG | + | CAGGUGUGCACCACCAUGGC | 4545 |
| TCCCTAGTAGCTGGGATGAC | 1452 | AGG | + | UCCCUAGUAGCUGGGAUGAC | 4546 |
| TTTTGCCATATTGCTCAGGC | 1453 | TGG | - | UUUUGCCAUAUUGCUCAGGC | 4547 |
| ACTTGGAAGACTGAGGTGGG | 1454 | AGG | - | ACUUGGAAGACUGAGGUGGG | 4548 |
| CTCAGCACTTTGGGAGGGCG | 1455 | AGG | + | CUCAGCACUUUGGGAGGGCG | 4549 |
| GTGTCTGCCTGCTAGGGTCT | 1456 | TGG | - | GUGUCUGCCUGCUAGGGUCU | 4550 |
| TGTCATCCCAGCTACTAGGG | 1457 | AGG | - | UGUCAUCCCAGCUACUAGGG | 4551 |
| TGTGCCCACGGACCTAGGTG | 1458 | AGG | + | UGUGCCCACGGACCUAGGUG | 4552 |
| GCTACTTGGAAGACTGAGGT | 1459 | GGG | - | GCUACUUGGAAGACUGAGGU | 4553 |
| GCCCCGCTGCTCAAACCTCT | 1460 | GGG | - | GCCCCGCUGCUCAAACCUCU | 4554 |
| TCTAACACTTTGGGAGGCTG | 1461 | AGG | - | UCUAACACUUUGGGAGGCUG | 4555 |
| TCACCTAGGTCCGTGGGCAC | 1462 | AGG | - | UCACCUAGGUCCGUGGGCAC | 4556 |
| TCCCAGGTGGCTGGGATTAC | 1463 | AGG | + | UCCCAGGUGGCUGGGAUUAC | 4557 |
| AGCTACTTGGAAGACTGAGG | 1464 | TGG | - | AGCUACUUGGAAGACUGAGG | 4558 |
| CAGGCCGATCACTTGAGGTC | 1465 | AGG | - | CAGGCCGAUCACUUGAGGUC | 4559 |
| CAGACGTGTGCCACCACGCC | 1466 | CGG | + | CAGACGUGUGCCACCACGCC | 4560 |
| GTCTCAAATTCCTGGGCTCA | 1467 | AGG | - | GUCUCAAAUUCCUGGGCUCA | 4561 |
| ACTACAGGTGTGCACCACCA | 1468 | TGG | + | ACUACAGGUGUGCACCACCA | 4562 |
| GAGACAGGGTTTCACCACCT | 1469 | TGG | + | GAGACAGGGUUUCACCACCU | 4563 |
| TGTAATCCCAGCCACCTGGG | 1470 | AGG | - | UGUAAUCCCAGCCACCUGGG | 4564 |
| GACTGTAATCCCAGCACTTC | 1471 | AGG | + | GACUGUAAUCCCAGCACUUC | 4565 |
| CTCAAGCAATCCTCTGGCCT | 1472 | TGG | - | CUCAAGCAAUCCUCUGGCCU | 4566 |
| TCTCAAATTCCTGGGCTCAA | 1473 | GGG | - | UCUCAAAUUCCUGGGCUCAA | 4567 |
| AGGGTTTCACCACCTTGGCC | 1474 | AGG | + | AGGGUUUCACCACCUUGGCC | 4568 |
| CAGGCGTGAGCCCCTGCACC | 1475 | TGG | - | CAGGCGUGAGCCCCUGCACC | 4569 |
| TTGCTCAGGGTGGAGTGCAG | 1476 | TGG | + | UUGCUCAGGGUGGAGUGCAG | 4570 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| ATAGGCACAGGATGGGGCG | 1477 | TGG | - | AUAGGCACAGGAUGGGGCG | 4571 |
| CACTGCAGCCTTGAACTCCA | 1478 | GGG | - | CACUGCAGCCUUGAACUCCA | 4572 |
| GCTACTAGGGAGGCTGAGGG | 1479 | AGG | - | GCUACUAGGGAGGCUGAGGG | 4573 |
| CAGGCACGCACCACCACATC | 1480 | CGG | + | CAGGCACGCACCACCACAUC | 4574 |
| GCCACCTGGGAGGCTGAGGC | 1481 | AGG | - | GCCACCUGGGAGGCUGAGGC | 4575 |
| GAAGACTGCTTGAGCCCAGG | 1482 | AGG | + | GAAGACUGCUUGAGCCCAGG | 4576 |
| TCCTGCCTCAGCCTCCCAGG | 1483 | TGG | + | UCCUGCCUCAGCCUCCCAGG | 4577 |
| TAAATAAATAAAAATTAGCC | 1484 | AGG | - | UAAAUAAAUAAAAAUUAGCC | 4578 |
| TTAATTTTTTGTAGAGACG | 1485 | GGG | - | UUAAUUUUUUGUAGAGACG | 4579 |
| GCCTCAGCCTCCCAGGTGGC | 1486 | TGG | + | GCCUCAGCCUCCCAGGUGGC | 4580 |
| CCCTCAGCCTCCCTAGTAGC | 1487 | TGG | + | CCCUCAGCCUCCCUAGUAGC | 4581 |
| AAAAAAAAAAAAAAGACAT | 1488 | AGG | - | AAAAAAAAAAAAAAGACAU | 4582 |
| AAAAAAAAGCCAGGCACAG | 1489 | TGG | + | AAAAAAAAGCCAGGCACAG | 4583 |
| CCTGTCCTCACCTAGGTCCG | 1490 | TGG | - | CCUGUCCUCACCUAGGUCCG | 4584 |
| AACCCGGGAGATGGAGGTTG | 1491 | TGG | - | AACCCGGGAGAUGGAGGUUG | 4585 |
| GTCTGTAATCCCAGCCACTC | 1492 | GGG | - | GUCUGUAAUCCCAGCCACUC | 4586 |
| GGGTTTCAACATATGAATTT | 1493 | TGG | + | GGGUUUCAACAUAUGAAUUU | 4587 |
| CTGTCCTCACCTAGGTCCGT | 1494 | GGG | - | CUGUCCUCACCUAGGUCCGU | 4588 |
| CCACGGACCTAGGTGAGGAC | 1495 | AGG | + | CCACGGACCUAGGUGAGGAC | 4589 |
| TCTTGCTCTGTCACCCACAC | 1496 | TGG | - | UCUUGCUCUGUCACCCACAC | 4590 |
| TCTTAAGTAGCTGGGACTAC | 1497 | AGG | - | UCUUAAGUAGCUGGGACUAC | 4591 |
| TCACCACAACCTCCATCTCC | 1498 | CGG | + | UCACCACAACCUCCAUCUCC | 4592 |
| CCAGCTACTAGGGAGGCTGA | 1499 | GGG | - | CCAGCUACUAGGGAGGCUGA | 4593 |
| AGGAGTGCCTGTCCTCACCT | 1500 | AGG | - | AGGAGUGCCUGUCCUCACCU | 4594 |
| CACCACAACCTCCATCTCCC | 1501 | GGG | + | CACCACAACCUCCAUCUCCC | 4595 |
| GTTACTCAGGAAGCTGAGGC | 1502 | AGG | + | GUUACUCAGGAAGCUGAGGC | 4596 |
| TGTAGTCCCAGCTACTTAAG | 1503 | AGG | + | UGUAGUCCCAGCUACUUAAG | 4597 |
| CCAGAGGATTGCTTGAGCCC | 1504 | AGG | + | CCAGAGGAUUGCUUGAGCCC | 4598 |
| GGCTTGAGCCTGGGAGGTTG | 1505 | AGG | - | GGCUUGAGCCUGGGAGGUUG | 4599 |
| GATCAAGGTGCCAGCAGATT | 1506 | TGG | + | GAUCAAGGUGCCAGCAGAUU | 4600 |
| CCTCAGCCTCCCAGGTGGCT | 1507 | GGG | + | CCUCAGCCUCCCAGGUGGCU | 4601 |
| GGGAGGCTGAGGTGAGAGGA | 1508 | TGG | + | GGGAGGCUGAGGUGAGAGGA | 4602 |
| CCCAGCCACCTGGGAGGCTG | 1509 | AGG | - | CCCAGCCACCUGGGAGGCUG | 4603 |
| ACAGGTGCAGCACACCAACA | 1510 | TGG | + | ACAGGUGCAGCACACCAACA | 4604 |
| GCACCACTGCACTCCAGTGT | 1511 | GGG | + | GCACCACUGCACUCCAGUGU | 4605 |
| GCCTCAGCTTCCTGAGTAAC | 1512 | TGG | - | GCCUCAGCUUCCUGAGUAAC | 4606 |
| TGAGAGGATGGCTTGAGCCC | 1513 | TGG | + | UGAGAGGAUGGCUUGAGCCC | 4607 |
| TGTAATTCTAACACTTTGGG | 1514 | AGG | - | UGUAAUUCUAACACUUUGGG | 4608 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CCTGGGCTCAAGCAATCCTC | 1515 | TGG | - | CCUGGGCUCAAGCAAUCCUC | 4609 |
| GAGCCAGGGTTTCACCATGT | 1516 | TGG | + | GAGCCAGGGUUUCACCAUGU | 4610 |
| GAGAATCGATTGAACCCAGG | 1517 | CGG | - | GAGAAUCGAUUGAACCCAGG | 4611 |
| GGTTTCAACATATGAATTTT | 1518 | GGG | + | GGUUUCAACAUAUGAAUUUU | 4612 |
| GGAGTGCAGTGGTGCAATAT | 1519 | CGG | + | GGAGUGCAGUGGUGCAAUAU | 4613 |
| ATACAAAAATTAGCCGGCCA | 1520 | TGG | - | AUACAAAAAUUAGCCGGCCA | 4614 |
| CCCAGTTACTCAGGAAGCTG | 1521 | AGG | + | CCCAGUUACUCAGGAAGCUG | 4615 |
| CAAAAATTAGCCGGCCATGG | 1522 | TGG | - | CAAAAAUUAGCCGGCCAUGG | 4616 |
| AAATAAAAATTAGCCAGGTG | 1523 | TGG | - | AAAUAAAAAUUAGCCAGGUG | 4617 |
| CAGGTGCATACCACCACACC | 1524 | TGG | - | CAGGUGCAUACCACCACACC | 4618 |
| GCACTTTGGGAAGCTGAGAC | 1525 | AGG | - | GCACUUUGGGAAGCUGAGAC | 4619 |
| CCTCAGCTTCCTGAGTAACT | 1526 | GGG | - | CCUCAGCUUCCUGAGUAACU | 4620 |
| CTTTGGGAGGGCGAGGTGGG | 1527 | AGG | + | CUUUGGGAGGGCGAGGUGGG | 4621 |
| GCTACTTAAGAGGCTGAGGC | 1528 | AGG | + | GCUACUUAAGAGGCUGAGGC | 4622 |
| TGGGAAGACTGCTTGAGCCC | 1529 | AGG | + | UGGGAAGACUGCUUGAGCCC | 4623 |
| GTTTCAACATATGAATTTTG | 1530 | GGG | + | GUUUCAACAUAUGAAUUUUG | 4624 |
| GCCTCAGCCTCTTAAGTAGC | 1531 | TGG | - | GCCUCAGCCUCUUAAGUAGC | 4625 |
| CAAGGCAGGTGGATCACCTA | 1532 | AGG | + | CAAGGCAGGUGGAUCACCUA | 4626 |
| TTCAACATATGAATTTTGGG | 1533 | GGG | + | UUCAACAUAUGAAUUUUGGG | 4627 |
| CTGCCACTGTACTCCAGCCT | 1534 | GGG | + | CUGCCACUGUACUCCAGCCU | 4628 |
| TTGTGTTTTTGTAGAGACA | 1535 | GGG | + | UUGUGUUUUUGUAGAGACA | 4629 |
| TTTCACCACCTTGGCCAGGC | 1536 | TGG | + | UUUCACCACCUUGGCCAGGC | 4630 |
| TCTCGCTCAGTCACCCAGGC | 1537 | TGG | - | UCUCGCUCAGUCACCCAGGC | 4631 |
| TGCATTTCCCAAGACCACCC | 1538 | TGG | + | UGCAUUUCCCAAGACCACCC | 4632 |
| TCTTTCTTTCTTTTTTGAGA | 1539 | TGG | - | UCUUUCUUUCUUUUUUGAGA | 4633 |
| CCTCAGTCTTCCAAGTAGCT | 1540 | CGG | + | CCUCAGUCUUCCAAGUAGCU | 4634 |
| CTTTGGGAGGACAAGGCAGG | 1541 | TGG | + | CUUUGGGAGGACAAGGCAGG | 4635 |
| GAGTGCAAGGTTTTATTGAG | 1542 | TGG | - | GAGUGCAAGGUUUUAUUGAG | 4636 |
| GTAATCTCAGCACTTTGGGA | 1543 | GGG | + | GUAAUCUCAGCACUUUGGGA | 4637 |
| CAAACATTAGCCAGGCATGG | 1544 | TGG | + | CAAACAUUAGCCAGGCAUGG | 4638 |
| TGAGACCAGCCTGGGCAGCA | 1545 | TGG | - | UGAGACCAGCCUGGGCAGCA | 4639 |
| ATACAAACATTAGCCAGGCA | 1546 | TGG | + | AUACAAACAUUAGCCAGGCA | 4640 |
| TATTATTATTATTTTGAGAC | 1547 | AGG | - | UAUUAUUAUUAUUUUGAGAC | 4641 |
| CCCAGCTACTTAAGAGGCTG | 1548 | AGG | + | CCCAGCUACUUAAGAGGCUG | 4642 |
| TCACCCACACTGGAGTGCAG | 1549 | TGG | - | UCACCCACACUGGAGUGCAG | 4643 |
| GCACTTTGGGAGGGCGAGGT | 1550 | GGG | + | GCACUUUGGGAGGGCGAGGU | 4644 |
| GAGACAGGGTTTTGCTATGT | 1551 | TGG | - | GAGACAGGGUUUUGCUAUGU | 4645 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CCTCAGCCTCTTAAGTAGCT | 1552 | GGG | - | CCUCAGCCUCUUAAGUAGCU | 4646 |
| AGGGTTTTGCTATGTTGGCC | 1553 | AGG | - | AGGGUUUUGCUAUGUUGGCC | 4647 |
| TTTGTGTTTTTTGTAGAGAC | 1554 | AGG | + | UUUGUGUUUUUUGUAGAGAC | 4648 |
| TTTCAACATATGAATTTTGG | 1555 | GGG | + | UUUCAACAUAUGAAUUUUGG | 4649 |
| GGGGCCTTTGGGAGGTGATT | 1556 | AGG | - | GGGGCCUUUGGGAGGUGAUU | 4650 |
| AGTGGAATTGCTGGGTCATA | 1557 | GGG | + | AGUGGAAUUGCUGGGUCAUA | 4651 |
| CACTGTAGCCTCAACCTCCC | 1558 | AGG | + | CACUGUAGCCUCAACCUCCC | 4652 |
| CAAAAACACAAAAATTAGC | 1559 | TGG | - | CAAAAACACAAAAAUUAGC | 4653 |
| GGAGTACAATGGCGCGATCT | 1560 | CGG | - | GGAGUACAAUGGCGCGAUCU | 4654 |
| TTTTTTTTTCTTTTGAGAC | 1561 | TGG | - | UUUUUUUUUCUUUUGAGAC | 4655 |
| TGGCCAACATGGTGAAACCC | 1562 | TGG | - | UGGCCAACAUGGUGAAACCC | 4656 |
| CGCTTGAACCCGGAAGGCAG | 1563 | AGG | + | CGCUUGAACCCGGAAGGCAG | 4657 |
| GAGACGGGGTTTCACCAGGT | 1564 | TGG | - | GAGACGGGGUUUCACCAGGU | 4658 |
| TGGGGCCTGTCGTGGGGTGG | 1565 | GGG | + | UGGGGCCUGUCGUGGGGUGG | 4659 |
| TCTCAGCTTCCCAAAGTGCT | 1566 | AGG | + | UCUCAGCUUCCCAAAGUGCU | 4660 |
| CTGGGGCCTGTCGTGGGGTG | 1567 | GGG | + | CUGGGGCCUGUCGUGGGGUG | 4661 |
| CGTTTGAACCTGGGAGGCGG | 1568 | AGG | - | CGUUUGAACCUGGGAGGCGG | 4662 |
| CACTGGGGCCTGTCGTGGGG | 1569 | TGG | + | CACUGGGGCCUGUCGUGGGG | 4663 |
| AACTCCTGACCTCAAGTGAT | 1570 | CGG | + | AACUCCUGACCUCAAGUGAU | 4664 |
| CAGGCTGGTCTTGAGCTCCT | 1571 | GGG | - | CAGGCUGGUCUUGAGCUCCU | 4665 |
| CGCGCCATTGTACTCCAGCC | 1572 | TGG | + | CGCGCCAUUGUACUCCAGCC | 4666 |
| CGCTTGAACCCGGGAGATGG | 1573 | AGG | - | CGCUUGAACCCGGGAGAUGG | 4667 |
| AGAGTCTTACTCTGTCGCCC | 1574 | AGG | + | AGAGUCUUACUCUGUCGCCC | 4668 |
| AAGAGGCTGAGGCAGGAGAA | 1575 | TGG | + | AAGAGGCUGAGGCAGGAGAA | 4669 |
| AAAAAACACAAAAATTAGCT | 1576 | GGG | - | AAAAAACACAAAAAUUAGCU | 4670 |
| ACTGGGGCCTGTCGTGGGT | 1577 | GGG | + | ACUGGGGCCUGUCGUGGGU | 4671 |
| GCACTTTGGGAGGACAAGGC | 1578 | AGG | + | GCACUUUGGGAGGACAAGGC | 4672 |
| GCCTTGGCCTCCTGAAGTGC | 1579 | TGG | - | GCCUUGGCCUCCUGAAGUGC | 4673 |
| GCCTTGTCCTCCCAAAGTGC | 1580 | TGG | - | GCCUUGUCCUCCCAAAGUGC | 4674 |
| AGCACTTTGGGAGGGCGAGG | 1581 | TGG | + | AGCACUUUGGGAGGGCGAGG | 4675 |
| ACACACTGGGGCCTGTCGTG | 1582 | GGG | + | ACACACUGGGGCCUGUCGUG | 4676 |
| TGGCTGTAATCCCAGCTACT | 1583 | CGG | + | UGGCUGUAAUCCCAGCUACU | 4677 |
| CAGGAGAATCACTTGAAACC | 1584 | CGG | - | CAGGAGAAUCACUUGAAACC | 4678 |
| TGCCTGTCATCCCAGCTACT | 1585 | AGG | - | UGCCUGUCAUCCCAGCUACU | 4679 |
| CACACACTGGGGCCTGTCGT | 1586 | GGG | + | CACACACUGGGGCCUGUCGU | 4680 |
| CAGGTGGATCACCTAAGGTC | 1587 | AGG | + | CAGGUGGAUCACCUAAGGUC | 4681 |
| TGTTGTTGTTGTTTTTGAGA | 1588 | TGG | + | UGUUGUUGUUGUUUUUGAGA | 4682 |
| TGCCTCTAATCCCAGCTACT | 1589 | CGG | + | UGCCUCUAAUCCCAGCUACU | 4683 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| GGAGTGCAGTGGAGCGATCT | 1590 | TGG | + | GGAGUGCAGUGGAGCGAUCU | 4684 |
| CCCAGCACTTCAGGAGGCCA | 1591 | AGG | + | CCCAGCACUUCAGGAGGCCA | 4685 |
| GGCTGTAATCCCAGCTACTC | 1592 | GGG | + | GGCUGUAAUCCCAGCUACUC | 4686 |
| TGCTTGAGCCCAGGAGGTCG | 1593 | AGG | + | UGCUUGAGCCCAGGAGGUCG | 4687 |
| TTTGTATTTTTGTAGAGACG | 1594 | GGG | - | UUUGUAUUUUUGUAGAGACG | 4688 |
| GGAGTCTTACTCTGTTGCCC | 1595 | AGG | + | GGAGUCUUACUCUGUUGCCC | 4689 |
| CCTTGGCCTCCTGAAGTGCT | 1596 | GGG | - | CCUUGGCCUCCUGAAGUGCU | 4690 |
| CAGGAGCTCAAGACCAGCCT | 1597 | GGG | + | CAGGAGCUCAAGACCAGCCU | 4691 |
| CCAGGCTGGTCTTGAGCTCC | 1598 | TGG | - | CCAGGCUGGUCUUGAGCUCC | 4692 |
| CCAGGAGCTCAAGACCAGCC | 1599 | TGG | + | CCAGGAGCUCAAGACCAGCC | 4693 |
| GAATTTCACTCTTGTTGCCC | 1600 | AGG | + | GAAUUUCACUCUUGUUGCCC | 4694 |
| CGATAGTTTGCTCAGAATGA | 1601 | TGG | - | CGAUAGUUUGCUCAGAAUGA | 4695 |
| CCCAGCACTTTGGGAGGACA | 1602 | AGG | + | CCCAGCACUUUGGGAGGACA | 4696 |
| ATTCTGAGCAAACTATCGCA | 1603 | AGG | + | AUUCUGAGCAAACUAUCGCA | 4697 |
| CTAAAGATACAAAAATTAGC | 1604 | CGG | - | CUAAAGAUACAAAAAUUAGC | 4698 |
| CCTTGTCCTCCCAAAGTGCT | 1605 | GGG | - | CCUUGUCCUCCCAAAGUGCU | 4699 |
| CGCTCCACTGCACTCCAGCC | 1606 | TGG | - | CGCUCCACUGCACUCCAGCC | 4700 |
| GCGCCATTGTACTCCAGCCT | 1607 | GGG | + | GCGCCAUUGUACUCCAGCCU | 4701 |
| ATCTCAAAAAAAAAAAAAAA | 1608 | AGG | + | AUCUCAAAAAAAAAAAAAAA | 4702 |
| GAGCGGGGAGGGATAGCATT | 1609 | AGG | + | GAGCGGGGAGGGAUAGCAUU | 4703 |
| TCAAGCGATTCTCCTGCCTC | 1610 | AGG | + | UCAAGCGAUUCUCCUGCCUC | 4704 |
| TTAATCCAGTCTATCACTGA | 1611 | TGG | - | UUAAUCCAGUCUAUCACUGA | 4705 |
| GAGAATCGCTTGAACCCGGA | 1612 | AGG | + | GAGAAUCGCUUGAACCCGGA | 4706 |
| GCCTCTAATCCCAGCTACTC | 1613 | GGG | + | GCCUCUAAUCCCAGCUACUC | 4707 |
| TTGTAATTTTAGTAGAGACG | 1614 | GGG | + | UUGUAAUUUUAGUAGAGACG | 4708 |
| AATCGCTTGAACCCGGGAGA | 1615 | TGG | - | AAUCGCUUGAACCCGGGAGA | 4709 |
| TTTTGCTATGTTGGCCAGGC | 1616 | TGG | - | UUUUGCUAUGUUGGCCAGGC | 4710 |
| TAAAAATACAAACATTAGCC | 1617 | AGG | + | UAAAAAUACAAACAUUAGCC | 4711 |
| TCACACACTGGGGCCTGTCG | 1618 | TGG | + | UCACACACUGGGGCCUGUCG | 4712 |
| CCATGTTGGTCAGGCTGGTC | 1619 | TGG | - | CCAUGUUGGUCAGGCUGGUC | 4713 |
| CCAGACCAGCCTGACCAACA | 1620 | TGG | + | CCAGACCAGCCUGACCAACA | 4714 |
| TGACTGTAATCCCAGCACTT | 1621 | TGG | + | UGACUGUAAUCCCAGCACUU | 4715 |
| CAGGCTGGTCTCAAATTCCT | 1622 | GGG | - | CAGGCUGGUCUCAAAUUCCU | 4716 |
| TGGGAGGATCCCTTGAGCCC | 1623 | AGG | + | UGGGAGGAUCCCUUGAGCCC | 4717 |
| TGCACCACTGCACTCCAGTC | 1624 | TGG | - | UGCACCACUGCACUCCAGUC | 4718 |
| TCTTACTCTGTCGCCCAGGC | 1625 | TGG | + | UCUUACUCUGUCGCCCAGGC | 4719 |
| TCTCACTCTGTTGCCCAGAC | 1626 | TGG | + | UCUCACUCUGUUGCCCAGAC | 4720 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| AACTGCTTGAACCCAGGAGG | 1627 | CGG | + | AACUGCUUGAACCCAGGAGG | 4721 |
| ACACAAAAATTAGCTGGGCA | 1628 | TGG | - | ACACAAAAAUUAGCUGGGCA | 4722 |
| GGATTACAGGCGTGAGCCAC | 1629 | GGG | + | GGAUUACAGGCGUGAGCCAC | 4723 |
| GCCGAGGTGGGCGGATCATG | 1630 | AGG | + | GCCGAGGUGGGCGGAUCAUG | 4724 |
| CAGAAGTTTGAGACCAGCCT | 1631 | GGG | - | CAGAAGUUUGAGACCAGCCU | 4725 |
| GAGGTCTCACTATGTTGCCC | 1632 | AGG | - | GAGGUCUCACUAUGUUGCCC | 4726 |
| TTTTGTATTTTTGTAGAGAC | 1633 | GGG | - | UUUUGUAUUUUUGUAGAGAC | 4727 |
| TCGGGAGTTCGAGACCAGCC | 1634 | TGG | - | UCGGGAGUUCGAGACCAGCC | 4728 |
| TGCCTGTAACCCCAGCACTT | 1635 | TGG | + | UGCCUGUAACCCCAGCACUU | 4729 |
| TTTGTAATTTTAGTAGAGAC | 1636 | GGG | + | UUUGUAAUUUUAGUAGAGAC | 4730 |
| GCTCCACTGCACTCCAGCCT | 1637 | GGG | - | GCUCCACUGCACUCCAGCCU | 4731 |
| GCAGGCAGATCACCTGAGGT | 1638 | CGG | - | GCAGGCAGAUCACCUGAGGU | 4732 |
| TCCTGAGTAACTGGGATTAC | 1639 | CGG | - | UCCUGAGUAACUGGGAUUAC | 4733 |
| CTTGGCCTCCCAAAGTGCTG | 1640 | GGG | - | CUUGGCCUCCCAAAGUGCUG | 4734 |
| CAGGTGTGTGCCACCACACC | 1641 | TGG | + | CAGGUGUGUGCCACCACACC | 4735 |
| CCAGGCTGGTCTCAAATTCC | 1642 | TGG | - | CCAGGCUGGUCUCAAAUUCC | 4736 |
| CCAGGAATTTGAGACCAGCC | 1643 | TGG | + | CCAGGAAUUUGAGACCAGCC | 4737 |
| TTTTTGTATTTTTGTAGAGA | 1644 | CGG | - | UUUUUGUAUUUUUGUAGAGA | 4738 |
| TGTAATCCCAGCACTTCAGG | 1645 | AGG | + | UGUAAUCCCAGCACUUCAGG | 4739 |
| GAGAACTGCTTGAACCCAGG | 1646 | AGG | + | GAGAACUGCUUGAACCCAGG | 4740 |
| CAGGAATTTGAGACCAGCCT | 1647 | GGG | + | CAGGAAUUUGAGACCAGCCU | 4741 |
| TCAGAAGTTTGAGACCAGCC | 1648 | TGG | - | UCAGAAGUUUGAGACCAGCC | 4742 |
| GACTGTAATCCCAGCACTTT | 1649 | GGG | + | GACUGUAAUCCCAGCACUUU | 4743 |
| GCACCACTGCACTCCAGTCT | 1650 | GGG | - | GCACCACUGCACUCCAGUCU | 4744 |
| TAAAAATTAGCCAGGTGTGG | 1651 | TGG | - | UAAAAAUUAGCCAGGUGUGG | 4745 |
| TTTTGTAATTTTAGTAGAGA | 1652 | CGG | + | UUUUGUAAUUUUAGUAGAGA | 4746 |
| TAAAAATACAAAAATCAGCT | 1653 | GGG | - | UAAAAAUACAAAAAUCAGCU | 4747 |
| GCCTCGGTCTCCCAAAGTGC | 1654 | TGG | + | GCCUCGGUCUCCCAAAGUGC | 4748 |
| GCACTTTGGGAGACCGAGGC | 1655 | GGG | - | GCACUUUGGGAGACCGAGGC | 4749 |
| AGCACTTTGGGAGACCGAGG | 1656 | CGG | - | AGCACUUUGGGAGACCGAGG | 4750 |
| ACCTCATGATCCGCCCACCT | 1657 | CGG | - | ACCUCAUGAUCCGCCCACCU | 4751 |
| CACTGCAACCTCTGCCTTCC | 1658 | GGG | - | CACUGCAACCUCUGCCUUCC | 4752 |
| TCTTACTCTGTTGCCCAGGC | 1659 | TGG | + | UCUUACUCUGUUGCCCAGGC | 4753 |
| CACTGCAGCCTCGACCTCCT | 1660 | GGG | - | CACUGCAGCCUCGACCUCCU | 4754 |
| AAAAAAAAAAAAAAAAGCC | 1661 | AGG | + | AAAAAAAAAAAAAAAAGCC | 4755 |
| GGGGTTTCTCCATGTTGGCC | 1662 | AGG | + | GGGGUUUCUCCAUGUUGGCC | 4756 |
| CAGGAGAACTGCTTGAACCC | 1663 | AGG | + | CAGGAGAACUGCUUGAACCC | 4757 |
| GGTGGGCGGATCATGAGGTC | 1664 | AGG | + | GGUGGGCGGAUCAUGAGGUC | 4758 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TTGCCCAGGCTGGAGTACAA | 1665 | TGG | - | UUGCCCAGGCUGGAGUACAA | 4759 |
| TCACTGCAGCCTCGACCTCC | 1666 | TGG | - | UCACUGCAGCCUCGACCUCC | 4760 |
| TCACTGCAACCTCTGCCTTC | 1667 | CGG | - | UCACUGCAACCUCUGCCUUC | 4761 |
| GGGATTACAGGCGTGAGCCA | 1668 | CGG | + | GGGAUUACAGGCGUGAGCCA | 4762 |
| GCCTGTAGTCCCAGCTACTA | 1669 | GGG | - | GCCUGUAGUCCCAGCUACUA | 4763 |
| CTAAAAATACAAAAATCAGC | 1670 | TGG | - | CUAAAAAUACAAAAAUCAGC | 4764 |
| CAGGCGCCCGCCACCACACC | 1671 | CGG | - | CAGGCGCCCGCCACCACACC | 4765 |
| CCCAGCACTTTGGGAGACCG | 1672 | AGG | - | CCCAGCACUUUGGGAGACCG | 4766 |
| TTGCCCAGACTGGAGTGCAG | 1673 | TGG | + | UUGCCCAGACUGGAGUGCAG | 4767 |
| CAAAAAAAAAAAAAAAAAA | 1674 | AGG | + | CAAAAAAAAAAAAAAAAAA | 4768 |
| ACACTTTGGGAGGCTGAGGT | 1675 | GGG | - | ACACUUUGGGAGGCUGAGGU | 4769 |
| CCTCGGTCTCCCAAAGTGCT | 1676 | GGG | + | CCUCGGUCUCCCAAAGUGCU | 4770 |
| TCACTGCAGCCTTGAACTCC | 1677 | AGG | - | UCACUGCAGCCUUGAACUCC | 4771 |
| AAAAAAAAAAAAAAAAAGA | 1678 | GGG | - | AAAAAAAAAAAAAAAAAGA | 4772 |
| GCCTGTAACCCCAGCACTTT | 1679 | GGG | + | GCCUGUAACCCCAGCACUUU | 4773 |
| ATTATTATACTTTAAGTTCT | 1680 | AGG | - | AUUAUUAUACUUUAAGUUCU | 4774 |
| TTGTATTTTTAGTAGAGACT | 1681 | GGG | - | UUGUAUUUUUAGUAGAGACU | 4775 |
| TCGCCCAGGCTGGAGTACAG | 1682 | TGG | - | UCGCCCAGGCUGGAGUACAG | 4776 |
| CGAGGCAGGCAGATCACCTG | 1683 | AGG | - | CGAGGCAGGCAGAUCACCUG | 4777 |
| CGAGGCAGGCAGATCACCTG | 1684 | AGG | - | CGAGGCAGGCAGAUCACCUG | 4778 |
| TCCCTAGTAGCTGGGACTAC | 1685 | AGG | + | UCCCUAGUAGCUGGGACUAC | 4779 |
| TTTCTCCATGTTGGCCAGGC | 1686 | TGG | + | UUUCUCCAUGUUGGCCAGGC | 4780 |
| AATACAAAATTAGCCAGGCA | 1687 | TGG | + | AAUACAAAAUUAGCCAGGCA | 4781 |
| TGTAGTCCCAGCTACTAGGG | 1688 | AGG | - | UGUAGUCCCAGCUACUAGGG | 4782 |
| GGAGTGCAATGGCGCAATCT | 1689 | CGG | - | GGAGUGCAAUGGCGCAAUCU | 4783 |
| ACAAAATTAGCCAGGCATGG | 1690 | TGG | + | ACAAAAUUAGCCAGGCAUGG | 4784 |
| AATGGTGTGAACCCGGGAGG | 1691 | CGG | + | AAUGGUGUGAACCCGGGAGG | 4785 |
| TTCTCCTGCCTCAGCCTCCC | 1692 | AGG | + | UUCUCCUGCCUCAGCCUCCC | 4786 |
| TCAGGAGTTCCAGACCAGCC | 1693 | TGG | - | UCAGGAGUUCCAGACCAGCC | 4787 |
| TCCCAAAGTGCTGGGGTTAC | 1694 | AGG | - | UCCCAAAGUGCUGGGGUUAC | 4788 |
| TGTAACCCCAGCACTTTGGG | 1695 | AGG | + | UGUAACCCCAGCACUUUGGG | 4789 |
| AAAAAAAAAAAAAAAAAAG | 1696 | AGG | - | AAAAAAAAAAAAAAAAAAG | 4790 |
| TACAAAAATTAGCCGGGTG | 1697 | TGG | + | UACAAAAAUUAGCCGGGUG | 4791 |
| CAGGTGTGAGCCACCACACC | 1698 | CGG | - | CAGGUGUGAGCCACCACACC | 4792 |
| AACACTTTGGGAGGCTGAGG | 1699 | TGG | - | AACACUUUGGGAGGCUGAGG | 4793 |
| GGTCTCGAACTCCCGACCTC | 1700 | AGG | + | GGUCUCGAACUCCCGACCUC | 4794 |
| TACAAAAAATTAGCCAGGTG | 1701 | TGG | + | UACAAAAAUUAGCCAGGUG | 4795 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CAGGCATGAGCCACCGCACC | 1702 | TGG | + | CAGGCAUGAGCCACCGCACC | 4796 |
| TGCGCCATTGCACTCCAGCC | 1703 | TGG | + | UGCGCCAUUGCACUCCAGCC | 4797 |
| TTATTATACTTTAAGTTCTA | 1704 | GGG | - | UUAUUAUACUUUAAGUUCUA | 4798 |
| GAGAATGGTGTGAACCCGGG | 1705 | AGG | + | GAGAAUGGUGUGAACCCGGG | 4799 |
| AATTAGCCGGGTGTGGTGGC | 1706 | GGG | + | AAUUAGCCGGGUGUGGUGGC | 4800 |
| CACCGCATGTTCTCACTCAT | 1707 | AGG | + | CACCGCAUGUUCUCACUCAU | 4801 |
| CAAGGCAGGTGGATCACCTG | 1708 | AGG | + | CAAGGCAGGUGGAUCACCUG | 4802 |
| CGCATGTTCTCACTCATAGG | 1709 | TGG | + | CGCAUGUUCUCACUCAUAGG | 4803 |
| AAATTAGCCGGGTGTGGTGG | 1710 | CGG | + | AAAUUAGCCGGGUGUGGUGG | 4804 |
| CGCCTGTAATCTCAGCACTT | 1711 | TGG | + | CGCCUGUAAUCUCAGCACUU | 4805 |
| CTCAGGTGATCTGCCTGCCT | 1712 | CGG | + | CUCAGGUGAUCUGCCUGCCU | 4806 |
| CTCAGGTGATCTGCCTGCCT | 1713 | CGG | + | CUCAGGUGAUCUGCCUGCCU | 4807 |
| GCTACTAGGGAGGCTGAGGC | 1714 | AGG | - | GCUACUAGGGAGGCUGAGGC | 4808 |
| TGCTTGAACCCAGGAGGCGG | 1715 | AGG | + | UGCUUGAACCCAGGAGGCGG | 4809 |
| GCCTCAGCCTCCCTAGTAGC | 1716 | TGG | + | GCCUCAGCCUCCCUAGUAGC | 4810 |
| GAGACGGGGTTTCTCCATGT | 1717 | TGG | + | GAGACGGGGUUUCUCCAUGU | 4811 |
| GAGTGAGAACATGCGGTGTT | 1718 | TGG | - | GAGUGAGAACAUGCGGUGUU | 4812 |
| GGTACATGTGCACAACGTGC | 1719 | AGG | - | GGUACAUGUGCACAACGUGC | 4813 |
| AAAAAATTAGCCGGGTGTGG | 1720 | TGG | + | AAAAAAUUAGCCGGGUGUGG | 4814 |
| CCTAGCACTTTGGGAGGCCG | 1721 | AGG | + | CCUAGCACUUUGGGAGGCCG | 4815 |
| CAGGCGTGAGCCACTGTGCC | 1722 | TGG | - | CAGGCGUGAGCCACUGUGCC | 4816 |
| CCCAGCTACTAGGGAGGCTG | 1723 | AGG | - | CCCAGCUACUAGGGAGGCUG | 4817 |
| CCCAGCTACTAGGGAGGCTG | 1724 | AGG | - | CCCAGCUACUAGGGAGGCUG | 4818 |
| CGCCTGTAATCCTAGCACTT | 1725 | TGG | + | CGCCUGUAAUCCUAGCACUU | 4819 |
| TGTAGGGACATGGATGAAGC | 1726 | TGG | + | UGUAGGGACAUGGAUGAAGC | 4820 |
| CCTCAGCCTCCCTAGTAGCT | 1727 | GGG | + | CCUCAGCCUCCCUAGUAGCU | 4821 |
| CCTCAGCCTCCCTAGTAGCT | 1728 | GGG | + | CCUCAGCCUCCCUAGUAGCU | 4822 |
| TGCCTGTAATCCTAGCACTT | 1729 | TGG | - | UGCCUGUAAUCCUAGCACUU | 4823 |
| CAGGCAGATCACCTGAGGTC | 1730 | AGG | - | CAGGCAGAUCACCUGAGGUC | 4824 |
| CAGGCAGATCACCTGAGGTC | 1731 | GGG | - | CAGGCAGAUCACCUGAGGUC | 4825 |
| GCATGTTCTCACTCATAGGT | 1732 | GGG | + | GCAUGUUCUCACUCAUAGGU | 4826 |
| CACCTATGAGTGAGAACATG | 1733 | CGG | - | CACCUAUGAGUGAGAACAUG | 4827 |
| GCAGGAGAATGGTGTGAACC | 1734 | CGG | + | GCAGGAGAAUGGUGUGAACC | 4828 |
| CAGGCATGAGCCACCATGCC | 1735 | CGG | - | CAGGCAUGAGCCACCAUGCC | 4829 |
| CAGGAGAATGGTGTGAACCC | 1736 | GGG | + | CAGGAGAAUGGUGUGAACCC | 4830 |
| CATGCCATTGCACTCCAGCC | 1737 | TGG | + | CAUGCCAUUGCACUCCAGCC | 4831 |
| TCTCACTATGTTGCCCAGGC | 1738 | TGG | - | UCUCACUAUGUUGCCCAGGC | 4832 |
| ATGCCATTGCACTCCAGCCT | 1739 | GGG | + | AUGCCAUUGCACUCCAGCCU | 4833 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| AAAAAATTAGCCAGGTGTGG | 1740 | TGG | + | AAAAAAUUAGCCAGGUGUGG | 4834 |
| TATGTATACATGTGCCATGT | 1741 | TGG | - | UAUGUAUACAUGUGCCAUGU | 4835 |
| GGGGTTTCACTGTGTTAGCC | 1742 | AGG | - | GGGGUUUCACUGUGUUAGCC | 4836 |
| GAGTTTCACTCTTGTTGCCC | 1743 | AGG | - | GAGUUUCACUCUUGUUGCCC | 4837 |
| CTCAGGTGATCCACCTGCCT | 1744 | TGG | - | CUCAGGUGAUCCACCUGCCU | 4838 |
| TTCACTCTTGTTGCCCAGGC | 1745 | TGG | + | UUCACUCUUGUUGCCCAGGC | 4839 |
| TTCACTCTTGTTGCCCAGGC | 1746 | TGG | - | UUCACUCUUGUUGCCCAGGC | 4840 |
| GCCTGTAATCTCAGCACTTT | 1747 | GGG | + | GCCUGUAAUCUCAGCACUUU | 4841 |
| GCGCCATTGCACTCCAGCCT | 1748 | GGG | + | GCGCCAUUGCACUCCAGCCU | 4842 |
| GGGGTTTCACCATGTTGGTC | 1749 | AGG | - | GGGGUUUCACCAUGUUGGUC | 4843 |
| ACCTCAGCCTCCTGAGTAGC | 1750 | TGG | - | ACCUCAGCCUCCUGAGUAGC | 4844 |
| AGCTACTCAGGAGGCTGAGG | 1751 | CGG | - | AGCUACUCAGGAGGCUGAGG | 4845 |
| AGCTACTCAGGAGGCTGAGG | 1752 | TGG | + | AGCUACUCAGGAGGCUGAGG | 4846 |
| GCTACTCAGGAGGCTGAGGT | 1753 | GGG | + | GCUACUCAGGAGGCUGAGGU | 4847 |
| TTTTTTTTTTTTTTGAGAC | 1754 | AGG | + | UUUUUUUUUUUUUUGAGAC | 4848 |
| TTTTTTTTTTTTTTGAGAC | 1755 | AGG | - | UUUUUUUUUUUUUUGAGAC | 4849 |
| TTTTTTTTTTTTTGAGACA | 1756 | GGG | + | UUUUUUUUUUUUUGAGACA | 4850 |
| TTTTTTTTTTTTTGAGACA | 1757 | GGG | - | UUUUUUUUUUUUUGAGACA | 4851 |
| TTTCACTGTGTTAGCCAGGA | 1758 | TGG | - | UUUCACUGUGUUAGCCAGGA | 4852 |
| TCACCCAGGCTGGAGTGCAA | 1759 | TGG | - | UCACCCAGGCUGGAGUGCAA | 4853 |
| ACCTGTAATCCCAGCTACTT | 1760 | GGG | + | ACCUGUAAUCCCAGCUACUU | 4854 |
| CTAAAAATACAAAATTAGCC | 1761 | AGG | + | CUAAAAAUACAAAAUUAGCC | 4855 |
| GCCTGTAATCCTAGCACTTT | 1762 | GGG | - | GCCUGUAAUCCUAGCACUUU | 4856 |
| GCCTGTAATCCTAGCACTTT | 1763 | GGG | + | GCCUGUAAUCCUAGCACUUU | 4857 |
| GGAGTGCAGTGGCGTGATCT | 1764 | TGG | + | GGAGUGCAGUGGCGUGAUCU | 4858 |
| GGAGTGCAGTGGCGTGATCT | 1765 | CGG | + | GGAGUGCAGUGGCGUGAUCU | 4859 |
| TCCCAAAGTGCTGAGATTAC | 1766 | AGG | - | UCCCAAAGUGCUGAGAUUAC | 4860 |
| TGTAATCTCAGCACTTTGGG | 1767 | AGG | + | UGUAAUCUCAGCACUUUGGG | 4861 |
| TAGACTGGATTAAGAAAATG | 1768 | TGG | + | UAGACUGGAUUAAGAAAAUG | 4862 |
| TTTCACCATGTTGGTCAGGC | 1769 | TGG | - | UUUCACCAUGUUGGUCAGGC | 4863 |
| CACTGCAACCTCCGCCTCCT | 1770 | GGG | - | CACUGCAACCUCCGCCUCCU | 4864 |
| GGAGTCTCGCTCTGTCGCCC | 1771 | AGG | - | GGAGUCUCGCUCUGUCGCCC | 4865 |
| AATGTGGCACATATACACCA | 1772 | TGG | + | AAUGUGGCACAUAUACACCA | 4866 |
| ACGCCACTGCACTCCAGCCT | 1773 | GGG | - | ACGCCACUGCACUCCAGCCU | 4867 |
| TCCCAAAGTGCTAGGATTAC | 1774 | AGG | + | UCCCAAAGUGCUAGGAUUAC | 4868 |
| TCCCAAAGTGCTAGGATTAC | 1775 | AGG | - | UCCCAAAGUGCUAGGAUUAC | 4869 |
| GGAGTGCAGTGGCGCGATCT | 1776 | TGG | - | GGAGUGCAGUGGCGCGAUCU | 4870 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| CACGCCACTGCACTCCAGCC | 1777 | TGG | - | CACGCCACUGCACUCCAGCC | 4871 |
| TGTAATCCTAGCACTTTGGG | 1778 | AGG | + | UGUAAUCCUAGCACUUUGGG | 4872 |
| CAAAAATTAGCTGGGCATGG | 1779 | TGG | - | CAAAAAUUAGCUGGGCAUGG | 4873 |
| CTTTGGGAGGCTGAGGTGGG | 1780 | AGG | - | CUUUGGGAGGCUGAGGUGGG | 4874 |
| GGTCTCAAACTCCTGACCTC | 1781 | AGG | - | GGUCUCAAACUCCUGACCUC | 4875 |
| GAGAATCGCTTGAACCCAGG | 1782 | AGG | + | GAGAAUCGCUUGAACCCAGG | 4876 |
| CAGGCGTGAGCCACCGCGCC | 1783 | CGG | + | CAGGCGUGAGCCACCGCGCC | 4877 |
| CTTTGGGAGGCCAAGGCAGG | 1784 | TGG | + | CUUUGGGAGGCCAAGGCAGG | 4878 |
| GGTCTTGAACTCCTGACCTC | 1785 | AGG | + | GGUCUUGAACUCCUGACCUC | 4879 |
| TCTCGCTCTGTCGCCCAGGC | 1786 | TGG | - | UCUCGCUCUGUCGCCCAGGC | 4880 |
| CTTTGGGAGGCCGAGGTGGG | 1787 | CGG | + | CUUUGGGAGGCCGAGGUGGG | 4881 |
| CACCTGTAATCCCAGCTACT | 1788 | TGG | + | CACCUGUAAUCCCAGCUACU | 4882 |
| CGCGCCACTGCACTCCAGCC | 1789 | TGG | + | CGCGCCACUGCACUCCAGCC | 4883 |
| ACCTGTAGTCCCAGCTACTC | 1790 | AGG | - | ACCUGUAGUCCCAGCUACUC | 4884 |
| AGGGTTTCACCATGTTGGCC | 1791 | AGG | + | AGGGUUUCACCAUGUUGGCC | 4885 |
| CACTGCAAGCTCCGCCTCCC | 1792 | GGG | - | CACUGCAAGCUCCGCCUCCC | 4886 |
| TGCCTGTAGTCCCAGCTACT | 1793 | AGG | - | UGCCUGUAGUCCCAGCUACU | 4887 |
| GGTCTCGAACTCCTGACCTC | 1794 | AGG | - | GGUCUCGAACUCCUGACCUC | 4888 |
| TCACTGCAAGCTCCGCCTCC | 1795 | CGG | - | UCACUGCAAGCUCCGCCUCC | 4889 |
| CACTGCAAGCTCCGCCTCCC | 1796 | AGG | + | CACUGCAACCUCCGCCUCCC | 4890 |
| GCACTTTGGGAGGCCGAGGT | 1797 | GGG | + | GCACUUUGGGAGGCCGAGGU | 4891 |
| TCACTGCAAGCTCCGCCTCC | 1798 | TGG | - | UCACUGCAACCUCCGCCUCC | 4892 |
| CAAGACCAGCCTGGCCAACA | 1799 | TGG | - | CAAGACCAGCCUGGCCAACA | 4893 |
| GAGATGGGGTTTCACCATGT | 1800 | TGG | - | GAGAUGGGGUUUCACCAUGU | 4894 |
| TGTAGTCCCAGCTACTCAGG | 1801 | AGG | + | UGUAGUCCCAGCUACUCAGG | 4895 |
| TGTAGTCCCAGCTACTCAGG | 1802 | AGG | - | UGUAGUCCCAGCUACUCAGG | 4896 |
| TCCTGAGTAGCTGGGACTAC | 1803 | AGG | + | UCCUGAGUAGCUGGGACUAC | 4897 |
| TCCTGAGTAGCTGGGACTAC | 1804 | AGG | - | UCCUGAGUAGCUGGGACUAC | 4898 |
| CAGGAGAATCGCTTGAACCC | 1805 | AGG | + | CAGGAGAAUCGCUUGAACCC | 4899 |
| CAGGAGAATCGCTTGAACCC | 1806 | GGG | - | CAGGAGAAUCGCUUGAACCC | 4900 |
| CGAGACCAGCCTGGCCAACA | 1807 | TGG | - | CGAGACCAGCCUGGCCAACA | 4901 |
| GCAGGAGAATCGCTTGAACC | 1808 | CGG | + | GCAGGAGAAUCGCUUGAACC | 4902 |
| GCAGGAGAATCGCTTGAACC | 1809 | CGG | - | GCAGGAGAAUCGCUUGAACC | 4903 |
| TGTAATCCCAGCTACTCGGG | 1810 | AGG | + | UGUAAUCCCAGCUACUCGGG | 4904 |
| TAAAAATACAAAAAATTAGC | 1811 | CGG | + | UAAAAAUACAAAAAAUUAGC | 4905 |
| GCGCCACTGCACTCCAGCCT | 1812 | GGG | + | GCGCCACUGCACUCCAGCCU | 4906 |
| TCCCAAGTAGCTGGGATTAC | 1813 | AGG | - | UCCCAAGUAGCUGGGAUUAC | 4907 |
| TGTAATCCCAGCTACTTGGG | 1814 | AGG | + | UGUAAUCCCAGCUACUUGGG | 4908 |

TABLE 2-continued

Human RS1 Intron 1 Guide RNA Target Sequences and Guide Sequences.

| Target | SEQ ID NO. | PAM | Direction | Guide | SEQ ID NO. |
| --- | --- | --- | --- | --- | --- |
| TCAGGAGTTCAAGACCAGCC | 1815 | TGG | - | UCAGGAGUUCAAGACCAGCC | 4909 |
| TCAGGAGTTCGAGACCAGCC | 1816 | TGG | + | UCAGGAGUUCGAGACCAGCC | 4910 |
| TCAGGAGTTCGAGACCAGCC | 1817 | TGG | - | UCAGGAGUUCGAGACCAGCC | 4911 |
| AAAAATACAAAAAATTAGCC | 1818 | AGG | + | AAAAAUACAAAAAAUUAGCC | 4912 |
| AAAAATACAAAAAATTAGCC | 1819 | GGG | + | AAAAAUACAAAAAAUUAGCC | 4913 |
| TCAGGAGATCGAGACCATCC | 1820 | TGG | + | UCAGGAGAUCGAGACCAUCC | 4914 |
| GCCTTGGCCTCCCAAAGTGC | 1821 | TGG | - | GCCUUGGCCUCCCAAAGUGC | 4915 |
| GCCTTGGCCTCCCAAAGTGC | 1822 | TGG | - | GCCUUGGCCUCCCAAAGUGC | 4916 |
| GCACTTTGGGAGGCCAAGGC | 1823 | AGG | + | GCACUUUGGGAGGCCAAGGC | 4917 |
| GCACTTTGGGAGGCCAAGGC | 1824 | AGG | + | GCACUUUGGGAGGCCAAGGC | 4918 |
| GCCTCAGCCTCCCAAAGTGC | 1825 | TGG | - | GCCUCAGCCUCCCAAAGUGC | 4919 |
| GCACTTTGGGAGGCTGAGGC | 1826 | GGG | + | GCACUUUGGGAGGCUGAGGC | 4920 |
| AGCACTTTGGGAGGCTGAGG | 1827 | CGG | + | AGCACUUUGGGAGGCUGAGG | 4921 |
| TCGCCCAGGCTGGAGTGCAG | 1828 | TGG | - | UCGCCCAGGCUGGAGUGCAG | 4922 |
| TCGCCCAGGCTGGAGTGCAG | 1829 | TGG | + | UCGCCCAGGCUGGAGUGCAG | 4923 |
| TTGTATTTTAGTAGAGACA | 1830 | GGG | + | UUGUAUUUUAGUAGAGACA | 4924 |
| TTGTATTTTAGTAGAGACA | 1831 | GGG | - | UUGUAUUUUAGUAGAGACA | 4925 |
| TTGCCCAGGCTGGAGTGCAG | 1832 | TGG | + | UUGCCCAGGCUGGAGUGCAG | 4926 |
| CACCTGTAATCCCAGCACTT | 1833 | TGG | + | CACCUGUAAUCCCAGCACUU | 4927 |
| GCCTGTAGTCCCAGCTACTC | 1834 | AGG | + | GCCUGUAGUCCCAGCUACUC | 4928 |
| ACCTGTAATCCCAGCACTTT | 1835 | GGG | + | ACCUGUAAUCCCAGCACUUU | 4929 |
| GCTACTTGGGAGGCTGAGGC | 1836 | AGG | + | GCUACUUGGGAGGCUGAGGC | 4930 |
| GCTACTCAGGAGGCTGAGGC | 1837 | GGG | - | GCUACUCAGGAGGCUGAGGC | 4931 |
| CCCAGCACTTTGGGAGGCCA | 1838 | AGG | + | CCCAGCACUUUGGGAGGCCA | 4932 |
| CCCAGCACTTTGGGAGGCCA | 1839 | AGG | + | CCCAGCACUUUGGGAGGCCA | 4933 |
| GCCTCAGCCTCCCAAGTAGC | 1840 | TGG | - | GCCUCAGCCUCCCAAGUAGC | 4934 |
| GCCTCGGCCTCCCAAAGTGC | 1841 | TGG | + | GCCUCGGCCUCCCAAAGUGC | 4935 |
| GCCTCGGCCTCCCAAAGTGC | 1842 | TGG | + | GCCUCGGCCUCCCAAAGUGC | 4936 |
| TTGTATTTTAGTAGAGATG | 1843 | GGG | - | UUGUAUUUUAGUAGAGAUG | 4937 |
| TTTTTTTTTTTTTTTGAGA | 1844 | TGG | - | UUUUUUUUUUUUUUUGAGA | 4938 |
| TTTTTTTTTTTTTTTGAGA | 1845 | CGG | - | UUUUUUUUUUUUUUUGAGA | 4939 |
| CCTTGGCCTCCCAAAGTGCT | 1846 | GGG | - | CCUUGGCCUCCCAAAGUGCU | 4940 |
| CCTTGGCCTCCCAAAGTGCT | 1847 | GGG | - | CCUUGGCCUCCCAAAGUGCU | 4941 |
| CCCAGCACTTTGGGAGGCTG | 1848 | AGG | + | CCCAGCACUUUGGGAGGCUG | 4942 |
| GCACTTTGGGAGGCCGAGGC | 1849 | AGG | - | GCACUUUGGGAGGCCGAGGC | 4943 |
| GCACTTTGGGAGGCCGAGGC | 1850 | AGG | - | GCACUUUGGGAGGCCGAGGC | 4944 |
| GCCTCAGCCTCCTGAGTAGC | 1851 | TGG | + | GCCUCAGCCUCCUGAGUAGC | 4945 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TTTGTATTTTAGTAGAGAT | 1852 | GGG | - | UUUGUAUUUUAGUAGAGAU | 4946 |
| TTTCACCATGTTGGCCAGGC | 1853 | TGG | + | UUUCACCAUGUUGGCCAGGC | 4947 |
| GCTACTCGGGAGGCTGAGGC | 1854 | AGG | + | GCUACUCGGGAGGCUGAGGC | 4948 |
| AGCACTTTGGGAGGCCGAGG | 1855 | TGG | + | AGCACUUUGGGAGGCCGAGG | 4949 |
| CCCAGCTACTTGGGAGGCTG | 1856 | AGG | + | CCCAGCUACUUGGGAGGCUG | 4950 |
| TGCCTGTAATCCCAGCACTT | 1857 | TGG | - | UGCCUGUAAUCCCAGCACUU | 4951 |
| CCTCAGCCTCCCAAAGTGCT | 1858 | GGG | - | CCUCAGCCUCCCAAAGUGCU | 4952 |
| CCTCAGCCTCCCAAGTAGCT | 1859 | GGG | - | CCUCAGCCUCCCAAGUAGCU | 4953 |
| CCCAGCTACTCAGGAGGCTG | 1860 | AGG | - | CCCAGCUACUCAGGAGGCUG | 4954 |
| CCCAGCTACTCAGGAGGCTG | 1861 | AGG | + | CCCAGCUACUCAGGAGGCUG | 4955 |
| GCCTCAGCCTCCCGAGTAGC | 1862 | TGG | - | GCCUCAGCCUCCCGAGUAGC | 4956 |
| CCTCAGCCTCCTGAGTAGCT | 1863 | GGG | - | CCUCAGCCUCCUGAGUAGCU | 4957 |
| CCTCAGCCTCCTGAGTAGCT | 1864 | GGG | + | CCUCAGCCUCCUGAGUAGCU | 4958 |
| CCCAGCTACTCGGGAGGCTG | 1865 | AGG | + | CCCAGCUACUCGGGAGGCUG | 4959 |
| TTGTATTTTAGTAGAGACG | 1866 | GGG | - | UUGUAUUUUAGUAGAGACG | 4960 |
| CCTCAGCCTCCCGAGTAGCT | 1867 | GGG | - | CCUCAGCCUCCCGAGUAGCU | 4961 |
| CCCAGCACTTTGGGAGGCCG | 1868 | AGG | - | CCCAGCACUUUGGGAGGCCG | 4962 |
| CCCAGCACTTTGGGAGGCCG | 1869 | AGG | - | CCCAGCACUUUGGGAGGCCG | 4963 |
| CCTCGGCCTCCCAAAGTGCT | 1870 | AGG | - | CCUCGGCCUCCCAAAGUGCU | 4964 |
| CCTCGGCCTCCCAAAGTGCT | 1871 | GGG | + | CCUCGGCCUCCCAAAGUGCU | 4965 |
| CCTCGGCCTCCCAAAGTGCT | 1872 | GGG | + | CCUCGGCCUCCCAAAGUGCU | 4966 |
| CGCCTGTAATCCCAGCACTT | 1873 | TGG | + | CGCCUGUAAUCCCAGCACUU | 4967 |
| CGCCTGTAATCCCAGCACTT | 1874 | TGG | - | CGCCUGUAAUCCCAGCACUU | 4968 |
| CGCCTGTAATCCCAGCACTT | 1875 | TGG | - | CGCCUGUAAUCCCAGCACUU | 4969 |
| TTTGTATTTTAGTAGAGAC | 1876 | AGG | + | UUUGUAUUUUAGUAGAGAC | 4970 |
| TTTGTATTTTAGTAGAGAC | 1877 | AGG | - | UUUGUAUUUUAGUAGAGAC | 4971 |
| TTTGTATTTTAGTAGAGAC | 1878 | GGG | - | UUUGUAUUUUAGUAGAGAC | 4972 |
| TTTGTATTTTAGTAGAGAC | 1879 | TGG | - | UUUGUAUUUUAGUAGAGAC | 4973 |
| TTTTGTATTTTAGTAGAGA | 1880 | TGG | - | UUUUGUAUUUUAGUAGAGA | 4974 |
| TTTTGTATTTTAGTAGAGA | 1881 | CGG | - | UUUUGUAUUUUAGUAGAGA | 4975 |
| GCCTGTAATCCCAGCACTTT | 1882 | GGG | + | GCCUGUAAUCCCAGCACUUU | 4976 |
| GCCTGTAATCCCAGCACTTT | 1883 | GGG | - | GCCUGUAAUCCCAGCACUUU | 4977 |
| GCCTGTAATCCCAGCACTTT | 1884 | GGG | - | GCCUGUAAUCCCAGCACUUU | 4978 |
| GCCTGTAATCCCAGCACTTT | 1885 | GGG | - | GCCUGUAAUCCCAGCACUUU | 4979 |
| TCCCAAAGTGCTGGGATTAC | 1886 | AGG | - | UCCCAAAGUGCUGGGAUUAC | 4980 |
| TCCCAAAGTGCTGGGATTAC | 1887 | AGG | - | UCCCAAAGUGCUGGGAUUAC | 4981 |
| TCCCAAAGTGCTGGGATTAC | 1888 | AGG | + | UCCCAAAGUGCUGGGAUUAC | 4982 |
| TCCCAAAGTGCTGGGATTAC | 1889 | AGG | + | UCCCAAAGUGCUGGGAUUAC | 4983 |

TABLE 2-continued

Human RS1 Intron 1 Guide RNA Target Sequences and Guide Sequences.

| Target | SEQ ID NO. | PAM | Direction | Guide | SEQ ID NO. |
|---|---|---|---|---|---|
| TCCCAAAGTGCTGGGATTAC | 1890 | AGG | + | UCCCAAAGUGCUGGGAUUAC | 4984 |
| TGTAATCCCAGCACTTTGGG | 1891 | AGG | + | UGUAAUCCCAGCACUUUGGG | 4985 |
| TGTAATCCCAGCACTTTGGG | 1892 | AGG | + | UGUAAUCCCAGCACUUUGGG | 4986 |
| TGTAATCCCAGCACTTTGGG | 1893 | AGG | + | UGUAAUCCCAGCACUUUGGG | 4987 |
| TGTAATCCCAGCACTTTGGG | 1894 | AGG | - | UGUAAUCCCAGCACUUUGGG | 4988 |
| TGTAATCCCAGCACTTTGGG | 1895 | AGG | - | UGUAAUCCCAGCACUUUGGG | 4989 |

TABLE 3

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| ACCTGAGTAATAAAAATTGT | 1896 | TGG | + | ACCUGAGUAAUAAAAAUUGU | 4990 |
| TCCAACAATTTTTATTACTC | 1897 | AGG | - | UCCAACAAUUUUUAUUACUC | 4991 |
| CAACATGCCAATTAGTTCAC | 1898 | AGG | + | CAACAUGCCAAUUAGUUCAC | 4992 |
| TTAATAACCTGTGAACTAAT | 1899 | TGG | - | UUAAUAACCUGUGAACUAAU | 4993 |
| TCACAGGTTATTAATTTAAA | 1900 | AGG | + | UCACAGGUUAUUAAUUUAAA | 4994 |
| TTTAAAAGGTCACTGTTGTG | 1901 | TGG | + | UUUAAAAGGUCACUGUUGUG | 4995 |
| CTTTGTCACTGTCTTGCTCC | 1902 | TGG | + | CUUUGUCACUGUCUUGCUCC | 4996 |
| CTGTCTTGCTCCTGGCTTCC | 1903 | TGG | + | CUGUCUUGCUCCUGGCUUCC | 4997 |
| CCTGGCTTCCTGGTTTCATG | 1904 | AGG | + | CCUGGCUUCCUGGUUUCAUG | 4998 |
| CCTCATGAAACCAGGAAGCC | 1905 | AGG | - | CCUCAUGAAACCAGGAAGCC | 4999 |
| AGAAGGTTCCTCATGAAACC | 1906 | AGG | - | AGAAGGUUCCUCAUGAAACC | 5000 |
| AATATCATTTGAACTTTAGA | 1907 | AGG | - | AAUAUCAUUUGAACUUUAGA | 5001 |
| ATTGAAACTCAACAGAAAGA | 1908 | AGG | + | AUUGAAACUCAACAGAAAGA | 5002 |
| AAACTCAACAGAAAGAAGGA | 1909 | AGG | + | AAACUCAACAGAAAGAAGGA | 5003 |
| AACTCAACAGAAAGAAGGAA | 1910 | GGG | + | AACUCAACAGAAAGAAGGAA | 5004 |
| TTGTTTTTATAGAAACTCTG | 1911 | AGG | - | UUGUUUUUAUAGAAACUCUG | 5005 |
| TAATGAGAAGTCATGTTTCT | 1912 | TGG | + | UAAUGAGAAGUCAUGUUUCU | 5006 |
| TCATGTTTCTTGGAAATTTT | 1913 | AGG | + | UCAUGUUUCUUGGAAAUUUU | 5007 |
| TGTTTCTTGGAAATTTTAGG | 1914 | AGG | + | UGUUUCUUGGAAAUUUUAGG | 5008 |
| TAGAATTTAATATTGTAAGC | 1915 | CGG | + | UAGAAUUUAAUAUUGUAAGC | 5009 |
| TGTAAGCCGGACTATTACTG | 1916 | AGG | + | UGUAAGCCGGACUAUUACUG | 5010 |
| GTAAGCCGGACTATTACTGA | 1917 | GGG | + | GUAAGCCGGACUAUUACUGA | 5011 |
| CTTAACCCTCAGTAATAGTC | 1918 | CGG | - | CUUAACCCUCAGUAAUAGUC | 5012 |
| CGGACTATTACTGAGGGTTA | 1919 | AGG | + | CGGACUAUUACUGAGGGUUA | 5013 |
| GAAGCTATTAATAGCTCTGC | 1920 | TGG | + | GAAGCUAUUAAUAGCUCUGC | 5014 |
| AAGCTATTAATAGCTCTGCT | 1921 | GGG | + | AAGCUAUUAAUAGCUCUGCU | 5015 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| TGCTGGGACAAGTGTAAATG | 1922 | AGG | + | UGCUGGGACAAGUGUAAAUG | 5016 |
| GTGTAAATGAGGACTGTCCC | 1923 | AGG | + | GUGUAAAUGAGGACUGUCCC | 5017 |
| AGGACTGTCCCAGGCAAATC | 1924 | AGG | + | AGGACUGUCCCAGGCAAAUC | 5018 |
| TCCCAGGCAAATCAGGACAA | 1925 | AGG | + | UCCCAGGCAAAUCAGGACAA | 5019 |
| CCCAGGCAAATCAGGACAAA | 1926 | GGG | + | CCCAGGCAAAUCAGGACAAA | 5020 |
| CCCTTTGTCCTGATTTGCCT | 1927 | GGG | - | CCCUUUGUCCUGAUUUGCCU | 5021 |
| ACCCTTTGTCCTGATTTGCC | 1928 | TGG | - | ACCCUUUGUCCUGAUUUGCC | 5022 |
| GGGTCACCCTAGTTTAAATA | 1929 | TGG | + | GGGUCACCCUAGUUUAAAUA | 5023 |
| GCTAATCCATATTTAAACTA | 1930 | GGG | - | GCUAAUCCAUAUUUAAACUA | 5024 |
| TGCTAATCCATATTTAAACT | 1931 | AGG | - | UGCUAAUCCAUAUUUAAACU | 5025 |
| TTTAAATATGGATTAGCATA | 1932 | AGG | + | UUUAAAUAUGGAUUAGCAUA | 5026 |
| TATTAGACTGCAGTGGTGCT | 1933 | TGG | - | UAUUAGACUGCAGUGGUGCU | 5027 |
| AGACTTCTATTAGACTGCAG | 1934 | TGG | - | AGACUUCUAUUAGACUGCAG | 5028 |
| TAGGGTTTATTGACTTTCTT | 1935 | TGG | - | UAGGGUUUAUUGACUUUCUU | 5029 |
| TGGAATATATTGAGTCTTTA | 1936 | GGG | - | UGGAAUAUAUUGAGUCUUUA | 5030 |
| ATGGAATATATTGAGTCTTT | 1937 | AGG | - | AUGGAAUAUAUUGAGUCUUU | 5031 |
| ATTTAGAAGTTTAAAAGTGA | 1938 | TGG | - | AUUUAGAAGUUUAAAAGUGA | 5032 |
| CACTTTTAAACTTCTAAATG | 1939 | TGG | + | CACUUUUAAACUUCUAAAUG | 5033 |
| TAAACTTCTAAATGTGGCCC | 1940 | TGG | + | UAAACUUCUAAAUGUGGCCC | 5034 |
| CTTCTAAATGTGGCCCTGGC | 1941 | AGG | + | CUUCUAAAUGUGGCCCUGGC | 5035 |
| TAAGCATATTATGCCTGCCA | 1942 | GGG | - | UAAGCAUAUUAUGCCUGCCA | 5036 |
| TTAAGCATATTATGCCTGCC | 1943 | AGG | - | UUAAGCAUAUUAUGCCUGCC | 5037 |
| AGGCATAATATGCTTAAATA | 1944 | AGG | + | AGGCAUAAUAUGCUUAAAUA | 5038 |
| AGAGAGTATTATGTCTAAGA | 1945 | TGG | - | AGAGAGUAUUAUGUCUAAGA | 5039 |
| GGGCACTAGAGAGGTAAGAG | 1946 | AGG | - | GGGCACUAGAGAGGUAAGAG | 5040 |
| TGAATTGATGGGCACTAGAG | 1947 | AGG | - | UGAAUUGAUGGGCACUAGAG | 5041 |
| AAAGGAATTCTGAATTGAT | 1948 | GGG | - | AAAAGGAAUUCUGAAUUGAU | 5042 |
| TAAAGGAATTCTGAATTGA | 1949 | TGG | - | UAAAAGGAAUUCUGAAUUGA | 5043 |
| TTGAAAGTATAAACTTTAAA | 1950 | AGG | - | UUGAAAGUAUAAACUUUAAA | 5044 |
| TACTTTCAAATATTAAAAAT | 1951 | TGG | + | UACUUUCAAAUAUUAAAAAU | 5045 |
| AAATATTAAAAATTGGTTGA | 1952 | AGG | + | AAAUAUUAAAAAUUGGUUGA | 5046 |
| AATATTAAAAATTGGTTGAA | 1953 | GGG | + | AAUAUUAAAAAUUGGUUGAA | 5047 |
| TTAAAAATTGGTTGAAGGGT | 1954 | TGG | + | UUAAAAAUUGGUUGAAGGGU | 5048 |
| TAAAAATTGGTTGAAGGGTT | 1955 | GGG | + | UAAAAAUUGGUUGAAGGGUU | 5049 |
| AAAAATTGGTTGAAGGGTTG | 1956 | GGG | + | AAAAAUUGGUUGAAGGGUUG | 5050 |
| TGGTTGAAGGGTTGGGGATG | 1957 | TGG | + | UGGUUGAAGGGUUGGGGAUG | 5051 |
| GGGTTGGGGATGTGGCTCAG | 1958 | TGG | + | GGGUUGGGGAUGUGGCUCAG | 5052 |
| GACTCATGAAGGCTGGGCAG | 1959 | GGG | - | GACUCAUGAAGGCUGGGCAG | 5053 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| GGACTCATGAAGGCTGGGCA | 1960 | GGG | - | GGACUCAUGAAGGCUGGGCA | 5054 |
| GGGACTCATGAAGGCTGGGC | 1961 | AGG | - | GGGACUCAUGAAGGCUGGGC | 5055 |
| CTCAGGGACTCATGAAGGCT | 1962 | GGG | - | CUCAGGGACUCAUGAAGGCU | 5056 |
| ACTCAGGGACTCATGAAGGC | 1963 | TGG | - | ACUCAGGGACUCAUGAAGGC | 5057 |
| TTTAACTCAGGGACTCATGA | 1964 | AGG | - | UUUAACUCAGGGACUCAUGA | 5058 |
| GCTTCTGGGAATTTAACTCA | 1965 | GGG | - | GCUUCUGGGAAUUUAACUCA | 5059 |
| TGCTTCTGGGAATTTAACTC | 1966 | AGG | - | UGCUUCUGGGAAUUUAACUC | 5060 |
| GTTTGTCTTATACTGCTTCT | 1967 | GGG | - | GUUUGUCUUAUACUGCUUCU | 5061 |
| TGTTTGTCTTATACTGCTTC | 1968 | TGG | - | UGUUUGUCUUAUACUGCUUC | 5062 |
| ACCTTACTTCATCCATTTTC | 1969 | TGG | + | ACCUUACUUCAUCCAUUUUC | 5063 |
| GCCAGAAAATGGATGAAGTA | 1970 | AGG | - | GCCAGAAAAUGGAUGAAGUA | 5064 |
| TGTGTAGCTATGCCAGAAAA | 1971 | TGG | - | UGUGUAGCUAUGCCAGAAAA | 5065 |
| CATACCTGCAATCCTAGTTC | 1972 | TGG | + | CAUACCUGCAAUCCUAGUUC | 5066 |
| TTGTCCAGAACTAGGATTGC | 1973 | AGG | - | UUGUCCAGAACUAGGAUUGC | 5067 |
| GCTTGAATTTGTCCAGAACT | 1974 | AGG | - | GCUUGAAUUUGUCCAGAACU | 5068 |
| AGTTCTGGACAAATTCAAGC | 1975 | AGG | + | AGUUCUGGACAAAUUCAAGC | 5069 |
| AATGCCAACCTCAGCTACTT | 1976 | AGG | + | AAUGCCAACCUCAGCUACUU | 5070 |
| CAAACCTAAGTAGCTGAGGT | 1977 | TGG | - | CAAACCUAAGUAGCUGAGGU | 5071 |
| CAACCTCAGCTACTTAGGTT | 1978 | TGG | + | CAACCUCAGCUACUUAGGUU | 5072 |
| AACCTCAGCTACTTAGGTTT | 1979 | GGG | + | AACCUCAGCUACUUAGGUUU | 5073 |
| AGCCCAAACCTAAGTAGCTG | 1980 | AGG | - | AGCCCAAACCUAAGUAGCUG | 5074 |
| CTGAGACCCTGTCTTAACAT | 1981 | TGG | + | CUGAGACCCUGUCUUAACAU | 5075 |
| TGAGACCCTGTCTTAACATT | 1982 | GGG | + | UGAGACCCUGUCUUAACAUU | 5076 |
| GAGACCCTGTCTTAACATTG | 1983 | GGG | + | GAGACCCUGUCUUAACAUUG | 5077 |
| AGACCCTGTCTTAACATTGG | 1984 | GGG | + | AGACCCUGUCUUAACAUUGG | 5078 |
| TCTCCCCCAATGTTAAGACA | 1985 | GGG | - | UCUCCCCCAAUGUUAAGACA | 5079 |
| CTCTCCCCCAATGTTAAGAC | 1986 | AGG | - | CUCUCCCCCAAUGUUAAGAC | 5080 |
| TTAACATTGGGGGAGAGCCT | 1987 | AGG | + | UUAACAUUGGGGGAGAGCCU | 5081 |
| ATTGGGGGAGAGCCTAGGCT | 1988 | AGG | + | AUUGGGGGAGAGCCUAGGCU | 5082 |
| TGTATAGCTCAGCCTAGCCT | 1989 | AGG | - | UGUAUAGCUCAGCCUAGCCU | 5083 |
| CTATACAGTAAGCCTCTGTC | 1990 | TGG | + | CUAUACAGUAAGCCUCUGUC | 5084 |
| TATACAGTAAGCCTCTGTCT | 1991 | GGG | + | UAUACAGUAAGCCUCUGUCU | 5085 |
| CAGTAAGCCTCTGTCTGGGA | 1992 | AGG | + | CAGUAAGCCUCUGUCUGGGA | 5086 |
| TAAGCCTCTGTCTGGGAAGG | 1993 | AGG | + | UAAGCCUCUGUCUGGGAAGG | 5087 |
| AAGCCTCTGTCTGGGAAGGA | 1994 | GGG | + | AAGCCUCUGUCUGGGAAGGA | 5088 |
| TTTCCCTCCTTCCCAGACAG | 1995 | AGG | - | UUUCCCUCCUUCCCAGACAG | 5089 |
| TGTCTGGGAAGGAGGGAAAA | 1996 | AGG | + | UGUCUGGGAAGGAGGGAAAA | 5090 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| TGGGAAGGAGGGAAAAAGGA | 1997 | AGG | + | UGGGAAGGAGGGAAAAAGGA | 5091 |
| GAAAAAGGAAGGAAAGACAT | 1998 | TGG | + | GAAAAAGGAAGGAAAGACAU | 5092 |
| GACATTGGTTGAATGACTTG | 1999 | TGG | + | GACAUUGGUUGAAUGACUUG | 5093 |
| ACATTGGTTGAATGACTTGT | 2000 | GGG | + | ACAUUGGUUGAAUGACUUGU | 5094 |
| ACTGTATGTTTAGAGTGTTC | 2001 | AGG | + | ACUGUAUGUUUAGAGUGUUC | 5095 |
| CTGTATGTTTAGAGTGTTCA | 2002 | GGG | + | CUGUAUGUUUAGAGUGUUCA | 5096 |
| GTTTAGAGTGTTCAGGGAAA | 2003 | AGG | + | GUUUAGAGUGUUCAGGGAAA | 5097 |
| TAGAGTGTTCAGGGAAAAGG | 2004 | AGG | + | UAGAGUGUUCAGGGAAAAGG | 5098 |
| AGGTCATTTGCAGAGCAGAG | 2005 | AGG | - | AGGUCAUUUGCAGAGCAGAG | 5099 |
| ATTCGTCTTATCTGAGTGGC | 2006 | AGG | - | AUUCGUCUUAUCUGAGUGGC | 5100 |
| GTGTATTCGTCTTATCTGAG | 2007 | TGG | - | GUGUAUUCGUCUUAUCUGAG | 5101 |
| CATGAATATAGAAGAAACAG | 2008 | AGG | - | CAUGAAUAUAGAAGAAACAG | 5102 |
| AATAAAAGACACAAGACTGC | 2009 | TGG | - | AAUAAAAGACACAAGACUGC | 5103 |
| CTAATAATATTTCTAGTGTC | 2010 | TGG | + | CUAAUAAUAUUUCUAGUGUC | 5104 |
| CTTGAGATTTTATTTTCACA | 2011 | AGG | - | CUUGAGAUUUUAUUUUCACA | 5105 |
| CTTGTGAAAATAAAATCTCA | 2012 | AGG | + | CUUGUGAAAAUAAAAUCUCA | 5106 |
| AATAAAATCTCAAGGTCATA | 2013 | CGG | + | AAUAAAAUCUCAAGGUCAUA | 5107 |
| TACGGCAAACACAAAGAAAC | 2014 | AGG | + | UACGGCAAACACAAAGAAAC | 5108 |
| GTCTTCAGACACTCCAGAAG | 2015 | AGG | + | GUCUUCAGACACUCCAGAAG | 5109 |
| TCTTCAGACACTCCAGAAGA | 2016 | GGG | + | UCUUCAGACACUCCAGAAGA | 5110 |
| CGAGATCTGATGCCCTCTTC | 2017 | TGG | - | CGAGAUCUGAUGCCCUCUUC | 5111 |
| GAGGGCATCAGATCTCGTTA | 2018 | CGG | + | GAGGGCAUCAGAUCUCGUUA | 5112 |
| GCATCAGATCTCGTTACGGA | 2019 | TGG | + | GCAUCAGAUCUCGUUACGGA | 5113 |
| GATGGTTGTGAGCCACCATG | 2020 | TGG | + | GAUGGUUGUGAGCCACCAUG | 5114 |
| GTGAGCCACCATGTGGTTGC | 2021 | TGG | + | GUGAGCCACCAUGUGGUUGC | 5115 |
| TGAGCCACCATGTGGTTGCT | 2022 | GGG | + | UGAGCCACCAUGUGGUUGCU | 5116 |
| AAATCCCAGCAACCACATGG | 2023 | TGG | - | AAAUCCCAGCAACCACAUGG | 5117 |
| TTCAAATCCCAGCAACCACA | 2024 | TGG | - | UUCAAAUCCCAGCAACCACA | 5118 |
| GGATTTGAACTTCAGACCTT | 2025 | CGG | + | GGAUUUGAACUUCAGACCUU | 5119 |
| CAGACCTTCGGAAGAGCAGT | 2026 | CGG | + | CAGACCUUCGGAAGAGCAGU | 5120 |
| AGACCTTCGGAAGAGCAGTC | 2027 | GGG | + | AGACCUUCGGAAGAGCAGUC | 5121 |
| GCACCCGACTGCTCTTCCGA | 2028 | AGG | - | GCACCCGACUGCUCUUCCGA | 5122 |
| GGCTGGTGAGATGGCTCAGT | 2029 | GGG | - | GGCUGGUGAGAUGGCUCAGU | 5123 |
| GGGCTGGTGAGATGGCTCAG | 2030 | TGG | - | GGGCUGGUGAGAUGGCUCAG | 5124 |
| TGAGCCATCTCACCAGCCCC | 2031 | AGG | + | UGAGCCAUCUCACCAGCCCC | 5125 |
| AAACCTGGGGCTGGTGAGA | 2032 | TGG | - | AAAACCUGGGGCUGGUGAGA | 5126 |
| AGAAAAAAAAAACCTGGGGC | 2033 | TGG | - | AGAAAAAAAAAACCUGGGGC | 5127 |
| ACTAAGAAAAAAAAAACCTG | 2034 | GGG | - | ACUAAGAAAAAAAAAACCUG | 5128 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| AACTAAGAAAAAAAAACCT | 2035 | GGG | - | AACUAAGAAAAAAAAACCU | 5129 |
| CAACTAAGAAAAAAAAACC | 2036 | TGG | - | CAACUAAGAAAAAAAAACC | 5130 |
| TATTGTTATTCTTTTGAGAC | 2037 | AGG | + | UAUUGUUAUUCUUUUGAGAC | 5131 |
| AGGATCCCACACTGAAACTC | 2038 | AGG | + | AGGAUCCCACACUGAAACUC | 5132 |
| GCTAGCCTGAGTTTCAGTGT | 2039 | GGG | - | GCUAGCCUGAGUUUCAGUGU | 5133 |
| GGCTAGCCTGAGTTTCAGTG | 2040 | TGG | - | GGCUAGCCUGAGUUUCAGUG | 5134 |
| GGCTAGCCTTCAATTTCCTA | 2041 | TGG | + | GGCUAGCCUUCAAUUUCCUA | 5135 |
| TCAAATCCATAGGAAATTGA | 2042 | AGG | - | UCAAAUCCAUAGGAAAUUGA | 5136 |
| TGCTATGAGGTCAAATCCAT | 2043 | AGG | - | UGCUAUGAGGUCAAAUCCAU | 5137 |
| GAAACTGGCTGACTGCTATG | 2044 | AGG | - | GAAACUGGCUGACUGCUAUG | 5138 |
| AGCACTCAGAAGGTGGAAAC | 2045 | TGG | - | AGCACUCAGAAGGUGGAAAC | 5139 |
| AAATCTTAGCACTCAGAAGG | 2046 | TGG | - | AAAUCUUAGCACUCAGAAGG | 5140 |
| TTGAAATCTTAGCACTCAGA | 2047 | AGG | - | UUGAAAUCUUAGCACUCAGA | 5141 |
| GGAATTGGGTGTGGTGGCTC | 2048 | AGG | - | GGAAUUGGGUGUGGUGGCUC | 5142 |
| ATCTTAGGAATTGGGTGTGG | 2049 | TGG | - | AUCUUAGGAAUUGGGUGUGG | 5143 |
| CATATCTTAGGAATTGGGTG | 2050 | TGG | - | CAUAUCUUAGGAAUUGGGUG | 5144 |
| AAAAACATATCTTAGGAATT | 2051 | GGG | - | AAAAACAUAUCUUAGGAAUU | 5145 |
| TAAAAACATATCTTAGGAAT | 2052 | TGG | - | UAAAAACAUAUCUUAGGAAU | 5146 |
| CTTGCTTAAAAACATATCTT | 2053 | AGG | - | CUUGCUUAAAAACAUAUCUU | 5147 |
| CTAAGATATGTTTTTAAGCA | 2054 | AGG | + | CUAAGAUAUGUUUUUAAGCA | 5148 |
| ATGTTTTTAAGCAAGGTTAT | 2055 | TGG | + | AUGUUUUUAAGCAAGGUUAU | 5149 |
| CACGTCATTGCAAAGGGTTA | 2056 | AGG | - | CACGUCAUUGCAAAGGGUUA | 5150 |
| ACCCTTTGCAATGACGTGTC | 2057 | AGG | + | ACCCUUUGCAAUGACGUGUC | 5151 |
| TCCTGACACGTCATTGCAAA | 2058 | GGG | - | UCCUGACACGUCAUUGCAAA | 5152 |
| TTCCTGACACGTCATTGCAA | 2059 | AGG | - | UUCCUGACACGUCAUUGCAA | 5153 |
| GACAACTGGAAAAAAAAAAA | 2060 | AGG | - | GACAACUGGAAAAAAAAAAA | 5154 |
| TTTTTTTTTTCCAGTTGTC | 2061 | AGG | + | UUUUUUUUUUCCAGUUGUC | 5155 |
| TTTTTTCCAGTTGTCAGGCC | 2062 | TGG | + | UUUUUUCCAGUUGUCAGGCC | 5156 |
| CCAGTTGTCAGGCCTGGCAA | 2063 | TGG | + | CCAGUUGUCAGGCCUGGCAA | 5157 |
| CCATTGCCAGGCCTGACAAC | 2064 | TGG | - | CCAUUGCCAGGCCUGACAAC | 5158 |
| CAGGCCTGGCAATGGAGCCC | 2065 | AGG | + | CAGGCCUGGCAAUGGAGCCC | 5159 |
| AGGCCTGGCAATGGAGCCCA | 2066 | GGG | + | AGGCCUGGCAAUGGAGCCCA | 5160 |
| GGGCCCTGGGCTCCATTGCC | 2067 | AGG | - | GGGCCCUGGGCUCCAUUGCC | 5161 |
| TTTAGCAAGCACAGGGCCCT | 2068 | GGG | - | UUUAGCAAGCACAGGGCCCU | 5162 |
| GTTTAGCAAGCACAGGGCCC | 2069 | TGG | - | GUUUAGCAAGCACAGGGCCC | 5163 |
| GCCCTGTGCTTGCTAAACGA | 2070 | TGG | + | GCCCUGUGCUUGCUAAACGA | 5164 |
| GCCATCGTTTAGCAAGCACA | 2071 | GGG | - | GCCAUCGUUUAGCAAGCACA | 5165 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| AGCCATCGTTTAGCAAGCAC | 2072 | AGG | - | AGCCAUCGUUUAGCAAGCAC | 5166 |
| GCTGGGTATATATAACTTAG | 2073 | GGG | - | GCUGGGUAUAUAUAACUUAG | 5167 |
| AGCTGGGTATATATAACTTA | 2074 | GGG | - | AGCUGGGUAUAUAUAACUUA | 5168 |
| AAGCTGGGTATATATAACTT | 2075 | AGG | - | AAGCUGGGUAUAUAUAACUU | 5169 |
| ATATATACCCAGCTTATCCC | 2076 | AGG | + | AUAUAUACCCAGCUUAUCCC | 5170 |
| GAAAGATCCTGGGATAAGCT | 2077 | GGG | - | GAAAGAUCCUGGGAUAAGCU | 5171 |
| AGAAAGATCCTGGGATAAGC | 2078 | TGG | - | AGAAAGAUCCUGGGAUAAGC | 5172 |
| GAAAGTCTGAGAAAGATCCT | 2079 | GGG | - | GAAAGUCUGAGAAAGAUCCU | 5173 |
| AGAAAGTCTGAGAAAGATCC | 2080 | TGG | - | AGAAAGUCUGAGAAAGAUCC | 5174 |
| CTATCGATGTTGCTTCTCTT | 2081 | TGG | + | CUAUCGAUGUUGCUUCUCUU | 5175 |
| CTTTTTGTGAGAAAAGAGCA | 2082 | AGG | - | CUUUUUGUGAGAAAAGAGCA | 5176 |
| TCTAAGCAAGAACCCTTGTC | 2083 | TGG | + | UCUAAGCAAGAACCCUUGUC | 5177 |
| ATCTCTCTGACTCCAGACAA | 2084 | GGG | - | AUCUCUCUGACUCCAGACAA | 5178 |
| TATCTCTCTGACTCCAGACA | 2085 | AGG | - | UAUCUCUCUGACUCCAGACA | 5179 |
| GTCAGAGAGATAGCTTAGTC | 2086 | TGG | + | GUCAGAGAGAUAGCUUAGUC | 5180 |
| TTTAAACAAGAAAAGTTCTG | 2087 | GGG | - | UUUAAACAAGAAAAGUUCUG | 5181 |
| TTTTAAACAAGAAAAGTTCT | 2088 | GGG | - | UUUUAAACAAGAAAAGUUCU | 5182 |
| TTTTTAAACAAGAAAAGTTC | 2089 | TGG | - | UUUUUAAACAAGAAAAGUUC | 5183 |
| CAAACAAACAAACAAAAACT | 2090 | AGG | + | CAAACAAACAAACAAAAACU | 5184 |
| CAAAAACTAGGCATGACAGC | 2091 | TGG | + | CAAAAACUAGGCAUGACAGC | 5185 |
| ACTAGGCATGACAGCTGGAG | 2092 | AGG | + | ACUAGGCAUGACAGCUGGAG | 5186 |
| AGGCATGACAGCTGGAGAGG | 2093 | TGG | + | AGGCAUGACAGCUGGAGAGG | 5187 |
| ATTAACAGCACTTGTTAAAG | 2094 | AGG | + | AUUAACAGCACUUGUUAAAG | 5188 |
| TGTTAAAGAGGACCTCAGCT | 2095 | TGG | + | UGUUAAAGAGGACCUCAGCU | 5189 |
| AGGACCTCAGCTTGGTTCCC | 2096 | AGG | + | AGGACCUCAGCUUGGUUCCC | 5190 |
| GGACCTCAGCTTGGTTCCCA | 2097 | GGG | + | GGACCUCAGCUUGGUUCCCA | 5191 |
| GAGCCCTGGGAACCAAGCTG | 2098 | AGG | - | GAGCCCUGGGAACCAAGCUG | 5192 |
| AACTGGAGTTATAGAGCCCT | 2099 | GGG | - | AACUGGAGUUAUAGAGCCCU | 5193 |
| GAACTGGAGTTATAGAGCCC | 2100 | TGG | - | GAACUGGAGUUAUAGAGCCC | 5194 |
| GGCTCTATAACTCCAGTTCC | 2101 | AGG | + | GGCUCUAUAACUCCAGUUCC | 5195 |
| GCTCTATAACTCCAGTTCCA | 2102 | GGG | + | GCUCUAUAACUCCAGUUCCA | 5196 |
| GCTGTCTGAGGCCCTGGAAC | 2103 | TGG | - | GCUGUCUGAGGCCCUGGAAC | 5197 |
| CAGGAGGCTGTCTGAGGCCC | 2104 | TGG | - | CAGGAGGCUGUCUGAGGCCC | 5198 |
| AGGCTACAGGAGGCTGTCTG | 2105 | AGG | - | AGGCUACAGGAGGCUGUCUG | 5199 |
| ATGCATGAAGAGGCTACAGG | 2106 | AGG | - | AUGCAUGAAGAGGCUACAGG | 5200 |
| CTGATGCATGAAGAGGCTAC | 2107 | AGG | - | CUGAUGCAUGAAGAGGCUAC | 5201 |
| GCCTCTTCATGCATCAGACA | 2108 | TGG | + | GCCUCUUCAUGCAUCAGACA | 5202 |
| ACCATGTCTGATGCATGAAG | 2109 | AGG | - | ACCAUGUCUGAUGCAUGAAG | 5203 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| GACATGGTCCATATGCATGC | 2110 | AGG | + | GACAUGGUCCAUAUGCAUGC | 5204 |
| GTGTTTGACCTGCATGCATA | 2111 | TGG | - | GUGUUUGACCUGCAUGCAUA | 5205 |
| AAAAATAAAAGTCTAAAAAA | 2112 | AGG | + | AAAAAUAAAAGUCUAAAAAA | 5206 |
| CATGCTATAATCCCAGTGCT | 2113 | AGG | + | CAUGCUAUAAUCCCAGUGCU | 5207 |
| ATGCTATAATCCCAGTGCTA | 2114 | GGG | + | AUGCUAUAAUCCCAGUGCUA | 5208 |
| CTATAATCCCAGTGCTAGGG | 2115 | AGG | + | CUAUAAUCCCAGUGCUAGGG | 5209 |
| ACATTTGCCTCCCTAGCACT | 2116 | GGG | - | ACAUUUGCCUCCCUAGCACU | 5210 |
| GACATTTGCCTCCCTAGCAC | 2117 | TGG | - | GACAUUUGCCUCCCUAGCAC | 5211 |
| GTGCTAGGGAGGCAAATGTC | 2118 | TGG | + | GUGCUAGGGAGGCAAAUGUC | 5212 |
| GGCAAATGTCTGGACCTTGT | 2119 | CGG | + | GGCAAAUGUCUGGACCUUGU | 5213 |
| AATGTCTGGACCTTGTCGGT | 2120 | CGG | + | AAUGUCUGGACCUUGUCGGU | 5214 |
| GACTGACTGGCCGACCGACA | 2121 | AGG | - | GACUGACUGGCCGACCGACA | 5215 |
| TGACTGGCTGGCTGACTGAC | 2122 | TGG | - | UGACUGGCUGGCUGACUGAC | 5216 |
| GCTAGGCTAGACTGACTGGC | 2123 | TGG | - | GCUAGGCUAGACUGACUGGC | 5217 |
| CTATGCTAGGCTAGACTGAC | 2124 | TGG | - | CUAUGCUAGGCUAGACUGAC | 5218 |
| CTAGCCTAGCATAGCCTACT | 2125 | AGG | + | CUAGCCUAGCAUAGCCUACU | 5219 |
| CACACCTAGTAGGCTATGCT | 2126 | AGG | - | CACACCUAGUAGGCUAUGCU | 5220 |
| TGGGCTGGAGCACACCTAGT | 2127 | AGG | - | UGGGCUGGAGCACACCUAGU | 5221 |
| GACAAGGTCTCTCATTGGGC | 2128 | TGG | - | GACAAGGUCUCUCAUUGGGC | 5222 |
| TAGAGACAAGGTCTCTCATT | 2129 | GGG | - | UAGAGACAAGGUCUCUCAUU | 5223 |
| TTAGAGACAAGGTCTCTCAT | 2130 | TGG | - | UUAGAGACAAGGUCUCUCAU | 5224 |
| AGACCTTGTCTCTAAAAAAA | 2131 | AGG | + | AGACCUUGUCUCUAAAAAAA | 5225 |
| GACCTTGTCTCTAAAAAAAA | 2132 | GGG | + | GACCUUGUCUCUAAAAAAAA | 5226 |
| TACCCTTTTTTTTAGAGACA | 2133 | AGG | - | UACCCUUUUUUUUAGAGACA | 5227 |
| GGTAGAAAGAAAAGACAAAA | 2134 | TGG | + | GGUAGAAAGAAAAGACAAAA | 5228 |
| GACAAAATGGATGTCTCCTG | 2135 | AGG | + | GACAAAAUGGAUGUCUCCUG | 5229 |
| CTCCTGAGGAATGATACCCA | 2136 | CGG | + | CUCCUGAGGAAUGAUACCCA | 5230 |
| ATCCGTGGGTATCATTCCTC | 2137 | AGG | - | AUCCGUGGGUAUCAUUCCUC | 5231 |
| GGACAATTGTGGGTATCCGT | 2138 | GGG | - | GGACAAUUGUGGGUAUCCGU | 5232 |
| AGGACAATTGTGGGTATCCG | 2139 | TGG | - | AGGACAAUUGUGGGUAUCCG | 5233 |
| GGATACCCACAATTGTCCTC | 2140 | TGG | + | GGAUACCCACAAUUGUCCUC | 5234 |
| GGAGACCAGAGGACAATTGT | 2141 | GGG | - | GGAGACCAGAGGACAAUUGU | 5235 |
| CGGAGACCAGAGGACAATTG | 2142 | TGG | - | CGGAGACCAGAGGACAAUUG | 5236 |
| GTATTGCACACGGAGACCAG | 2143 | AGG | - | GUAUUGCACACGGAGACCAG | 5237 |
| ACATGGGTTTGTATTGCACA | 2144 | CGG | - | ACAUGGGUUUGUAUUGCACA | 5238 |
| TGTTGCAAATATTCAGACAT | 2145 | GGG | - | UGUUGCAAAUAUUCAGACAU | 5239 |
| CTGTTGCAAATATTCAGACA | 2146 | TGG | - | CUGUUGCAAAUAUUCAGACA | 5240 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| CATGTCTGAATATTTGCAAC | 2147 | AGG | + | CAUGUCUGAAUAUUUGCAAC | 5241 |
| ATGTCTGAATATTTGCAACA | 2148 | GGG | + | AUGUCUGAAUAUUUGCAACA | 5242 |
| AGCACAGCTTTACTAGATGA | 2149 | GGG | - | AGCACAGCUUUACUAGAUGA | 5243 |
| AAGCACAGCTTTACTAGATG | 2150 | AGG | - | AAGCACAGCUUUACUAGAUG | 5244 |
| CATCTAGTAAAGCTGTGCTT | 2151 | TGG | + | CAUCUAGUAAAGCUGUGCUU | 5245 |
| GAAAATAAGACAGATGGGA | 2152 | GGG | - | GAAAAUAAGACAGAUGGGA | 5246 |
| AGAAAATAAGACAGATGGG | 2153 | AGG | - | AGAAAAUAAGACAGAUGGG | 5247 |
| AGTAGAAAATAAGACAGAT | 2154 | GGG | - | AGUAGAAAAUAAGACAGAU | 5248 |
| CAGTAGAAAATAAGACAGA | 2155 | TGG | - | CAGUAGAAAAUAAGACAGA | 5249 |
| CATCTGTCTTATTTTCTAC | 2156 | TGG | + | CAUCUGUCUUAUUUUCUAC | 5250 |
| ATTTTTCTACTGGTGTGCTA | 2157 | AGG | + | AUUUUUCUACUGGUGUGCUA | 5251 |
| GTGCTAAGGCACCATGACCA | 2158 | AGG | + | GUGCUAAGGCACCAUGACCA | 5252 |
| TCTCTAAGTTGCCTTGGTCA | 2159 | TGG | - | UCUCUAAGUUGCCUUGGUCA | 5253 |
| TCTTCTTCTCTAAGTTGCCT | 2160 | TGG | - | UCUUCUUCUCUAAGUUGCCU | 5254 |
| GAAGAAGAAACAGTTTATTG | 2161 | AGG | + | GAAGAAGAAACAGUUUAUUG | 5255 |
| AAGAAGAAACAGTTTATTGA | 2162 | GGG | + | AAGAAGAAACAGUUUAUUGA | 5256 |
| TTGAGGGTTTATAGTTATAG | 2163 | AGG | + | UUGAGGGUUUAUAGUUAUAG | 5257 |
| TGAGGGTTTATAGTTATAGA | 2164 | GGG | + | UGAGGGUUUAUAGUUAUAGA | 5258 |
| GTTTATAGTTATAGAGGGTA | 2165 | AGG | + | GUUUAUAGUUAUAGAGGGUA | 5259 |
| TAGTTATAGAGGGTAAGGCA | 2166 | AGG | + | UAGUUAUAGAGGGUAAGGCA | 5260 |
| TAGAGGGTAAGGCAAGGACT | 2167 | TGG | + | UAGAGGGUAAGGCAAGGACU | 5261 |
| TAAGGCAAGGACTTGGTAGC | 2168 | AGG | + | UAAGGCAAGGACUUGGUAGC | 5262 |
| GCAAGGACTTGGTAGCAGGC | 2169 | AGG | + | GCAAGGACUUGGUAGCAGGC | 5263 |
| GGACTTGGTAGCAGGCAGGC | 2170 | AGG | + | GGACUUGGUAGCAGGCAGGC | 5264 |
| TTGGTAGCAGGCAGGCAGGC | 2171 | AGG | + | UUGGUAGCAGGCAGGCAGGC | 5265 |
| AGCAGGCAGGCAGGCAGGCA | 2172 | TGG | + | AGCAGGCAGGCAGGCAGGCA | 5266 |
| CAGGCAGGCAGGCATGGTAC | 2173 | TGG | + | CAGGCAGGCAGGCAUGGUAC | 5267 |
| CATGGTACTGGTGTAGTAGC | 2174 | TGG | + | CAUGGUACUGGUGUAGUAGC | 5268 |
| ATGGTACTGGTGTAGTAGCT | 2175 | GGG | + | AUGGUACUGGUGUAGUAGCU | 5269 |
| GGAGCTTGTATCTTGAGACA | 2176 | CGG | + | GGAGCUUGUAUCUUGAGACA | 5270 |
| AAAGCTGAGAGATAGCTAAG | 2177 | TGG | + | AAAGCUGAGAGAUAGCUAAG | 5271 |
| AAGCTGAGAGATAGCTAAGT | 2178 | GGG | + | AAGCUGAGAGAUAGCUAAGU | 5272 |
| GAGAGATAGCTAAGTGGGCC | 2179 | TGG | + | GAGAGAUAGCUAAGUGGGCC | 5273 |
| AGGTTTCAAAAGCTCACACC | 2180 | AGG | - | AGGUUUCAAAAGCUCACACC | 5274 |
| TTTCACTGGGGACAGCTTTG | 2181 | AGG | - | UUUCACUGGGGACAGCUUUG | 5275 |
| TTGATGGAGGCATTTCACTG | 2182 | GGG | - | UUGAUGGAGGCAUUUCACUG | 5276 |
| GTTGATGGAGGCATTTCACT | 2183 | GGG | - | GUUGAUGGAGGCAUUUCACU | 5277 |
| TGTTGATGGAGGCATTTCAC | 2184 | TGG | - | UGUUGAUGGAGGCAUUUCAC | 5278 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| GTGAAATGCCTCCATCAACA | 2185 | AGG | + | GUGAAAUGCCUCCAUCAACA | 5279 |
| AGGTGTGGCCTTGTTGATGG | 2186 | AGG | - | AGGUGUGGCCUUGUUGAUGG | 5280 |
| GTTAGGTGTGGCCTTGTTGA | 2187 | TGG | - | GUUAGGUGUGGCCUUGUUGA | 5281 |
| TGTTTGGGAAGGGTTAGGTG | 2188 | TGG | - | UGUUUGGGAAGGGUUAGGUG | 5282 |
| AGAACTGTTTGGGAAGGGTT | 2189 | AGG | - | AGAACUGUUUGGGAAGGGUU | 5283 |
| TTGGTAGAACTGTTTGGGAA | 2190 | GGG | - | UUGGUAGAACUGUUUGGGAA | 5284 |
| GTTGGTAGAACTGTTTGGGA | 2191 | AGG | - | GUUGGUAGAACUGUUUGGGA | 5285 |
| TCCCAAACAGTTCTACCAAC | 2192 | TGG | + | UCCCAAACAGUUCUACCAAC | 5286 |
| CCCAAACAGTTCTACCAACT | 2193 | GGG | + | CCCAAACAGUUCUACCAACU | 5287 |
| CCCAGTTGGTAGAACTGTTT | 2194 | GGG | - | CCCAGUUGGUAGAACUGUUU | 5288 |
| TCCCAGTTGGTAGAACTGTT | 2195 | TGG | - | UCCCAGUUGGUAGAACUGUU | 5289 |
| ATGAATGCTTGGTTCCCAGT | 2196 | TGG | - | AUGAAUGCUUGGUUCCCAGU | 5290 |
| CTGAGGCTCATATGAATGCT | 2197 | TGG | - | CUGAGGCUCAUAUGAAUGCU | 5291 |
| CAAGCATTCATATGAGCCTC | 2198 | AGG | + | CAAGCAUUCAUAUGAGCCUC | 5292 |
| AAGCATTCATATGAGCCTCA | 2199 | GGG | + | AAGCAUUCAUAUGAGCCUCA | 5293 |
| AGCATTCATATGAGCCTCAG | 2200 | GGG | + | AGCAUUCAUAUGAGCCUCAG | 5294 |
| TGAATGAGACTGCTCCCCTG | 2201 | AGG | - | UGAAUGAGACUGCUCCCCUG | 5295 |
| GTACTCAGTACACTGCCCCA | 2202 | TGG | + | GUACUCAGUACACUGCCCCA | 5296 |
| TACTCAGTACACTGCCCCAT | 2203 | GGG | + | UACUCAGUACACUGCCCCAU | 5297 |
| TTAGAGGACTTCTGCCCATG | 2204 | GGG | - | UUAGAGGACUUCUGCCCAUG | 5298 |
| TTTAGAGGACTTCTGCCCAT | 2205 | GGG | - | UUUAGAGGACUUCUGCCCAU | 5299 |
| GTTTAGAGGACTTCTGCCCA | 2206 | TGG | - | GUUUAGAGGACUUCUGCCCA | 5300 |
| ATGGGCAGAAGTCCTCTAAA | 2207 | CGG | + | AUGGGCAGAAGUCCUCUAAA | 5301 |
| ACACATTAGTAACCGTTTAG | 2208 | AGG | - | ACACAUUAGUAACCGUUUAG | 5302 |
| TATCCCTCACCATACTTAGA | 2209 | AGG | + | UAUCCCUCACCAUACUUAGA | 5303 |
| TTTCCTTCTAAGTATGGTGA | 2210 | GGG | - | UUUCCUUCUAAGUAUGGUGA | 5304 |
| GTTTCCTTCTAAGTATGGTG | 2211 | AGG | - | GUUUCCUUCUAAGUAUGGUG | 5305 |
| GGCTTGTTTCCTTCTAAGTA | 2212 | TGG | - | GGCUUGUUUCCUUCUAAGUA | 5306 |
| GGAAACAAGCCATCCCAAAA | 2213 | TGG | + | GGAAACAAGCCAUCCCAAAA | 5307 |
| TCATGCTATCCATTTTGGGA | 2214 | TGG | - | UCAUGCUAUCCAUUUUGGGA | 5308 |
| TGAGTCATGCTATCCATTTT | 2215 | GGG | - | UGAGUCAUGCUAUCCAUUUU | 5309 |
| CTGAGTCATGCTATCCATTT | 2216 | TGG | - | CUGAGUCAUGCUAUCCAUUU | 5310 |
| TTGCTCTGGGTGAAGTACAC | 2217 | AGG | - | UUGCUCUGGGUGAAGUACAC | 5311 |
| TACTTCACCCAGAGCAAATG | 2218 | TGG | + | UACUUCACCCAGAGCAAAUG | 5312 |
| ACCCAGAGCAAATGTGGATA | 2219 | CGG | + | ACCCAGAGCAAAUGUGGAUA | 5313 |
| ACCGTATCCACATTTGCTCT | 2220 | GGG | - | ACCGUAUCCACAUUUGCUCU | 5314 |
| CACCGTATCCACATTTGCTC | 2221 | TGG | - | CACCGUAUCCACAUUUGCUC | 5315 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| CAGAGCAAATGTGGATACGG | 2222 | TGG | + | CAGAGCAAAUGUGGAUACGG | 5316 |
| AGAGCAAATGTGGATACGGT | 2223 | GGG | + | AGAGCAAAUGUGGAUACGGU | 5317 |
| GTGGATACGGTGGGAAACAG | 2224 | AGG | + | GUGGAUACGGUGGGAAACAG | 5318 |
| GGGAAACAGAGGACAGTGAT | 2225 | AGG | + | GGGAAACAGAGGACAGUGAU | 5319 |
| AGGACAGTGATAGGACACAA | 2226 | AGG | + | AGGACAGUGAUAGGACACAA | 5320 |
| GTCTCAGTTTCTAGTTCAGA | 2227 | TGG | + | GUCUCAGUUUCUAGUUCAGA | 5321 |
| AGACATAAACCAACACACAT | 2228 | AGG | + | AGACAUAAACCAACACACAU | 5322 |
| TGTATCTTTCCTATGTGTGT | 2229 | TGG | - | UGUAUCUUUCCUAUGUGUGU | 5323 |
| ATAGGAAAGATACACTCCAC | 2230 | TGG | + | AUAGGAAAGAUACACUCCAC | 5324 |
| AGATACACTCCACTGGACAG | 2231 | TGG | + | AGAUACACUCCACUGGACAG | 5325 |
| GATACACTCCACTGGACAGT | 2232 | GGG | + | GAUACACUCCACUGGACAGU | 5326 |
| CATGGGCTCCCACTGTCCAG | 2233 | TGG | - | CAUGGGCUCCCACUGUCCAG | 5327 |
| CAGTGGGAGCCCATGCACAA | 2234 | AGG | + | CAGUGGGAGCCCAUGCACAA | 5328 |
| GCCCATGCACAAAGGTTCTT | 2235 | TGG | + | GCCCAUGCACAAAGGUUCUU | 5329 |
| GCCAAAGAACCTTTGTGCAT | 2236 | GGG | - | GCCAAAGAACCUUUGUGCAU | 5330 |
| AGCCAAAGAACCTTTGTGCA | 2237 | TGG | - | AGCCAAAGAACCUUUGUGCA | 5331 |
| TGACAGCAGTTTCTTATTAT | 2238 | TGG | + | UGACAGCAGUUUCUUAUUAU | 5332 |
| GACAGCAGTTTCTTATTATT | 2239 | GGG | + | GACAGCAGUUUCUUAUUAUU | 5333 |
| GATGAGCTTTGTTTCTGCCC | 2240 | TGG | + | GAUGAGCUUUGUUUCUGCCC | 5334 |
| ATGAGCTTTGTTTCTGCCCT | 2241 | GGG | + | AUGAGCUUUGUUUCUGCCCU | 5335 |
| CCCTGGGTGAGAGTTTATTT | 2242 | AGG | + | CCCUGGGUGAGAGUUUAUUU | 5336 |
| CCTAAATAAACTCTCACCCA | 2243 | GGG | - | CCUAAAUAAACUCUCACCCA | 5337 |
| TCCTAAATAAACTCTCACCC | 2244 | AGG | - | UCCUAAAUAAACUCUCACCC | 5338 |
| CACACTAAGACAACCACTGA | 2245 | TGG | + | CACACUAAGACAACCACUGA | 5339 |
| ACTTTGTTCTAGGCCATCAG | 2246 | TGG | - | ACUUUGUUCUAGGCCAUCAG | 5340 |
| CAGTGCTCTGACTTTGTTCT | 2247 | AGG | - | CAGUGCUCUGACUUUGUUCU | 5341 |
| AGTCAGAGCACTGTGCGTTG | 2248 | TGG | + | AGUCAGAGCACUGUGCGUUG | 5342 |
| CACTGTGCGTTGTGGATCTT | 2249 | AGG | + | CACUGUGCGUUGUGGAUCUU | 5343 |
| GATGCTTTAATCATCATGAA | 2250 | TGG | - | GAUGCUUUAAUCAUCAUGAA | 5344 |
| ACTAACACATTTTAATAGGA | 2251 | TGG | - | ACUAACACAUUUUAAUAGGA | 5345 |
| ATGGACTAACACATTTTAAT | 2252 | AGG | - | AUGGACUAACACAUUUUAAU | 5346 |
| AAAATGTGTTAGTCCATTTT | 2253 | TGG | + | AAAAUGUGUUAGUCCAUUUU | 5347 |
| AAATGTGTTAGTCCATTTTT | 2254 | GGG | + | AAAUGUGUUAGUCCAUUUUU | 5348 |
| AATGTGTTAGTCCATTTTTG | 2255 | GGG | + | AAUGUGUUAGUCCAUUUUUG | 5349 |
| AGTAAACATAACCCCAAAAA | 2256 | TGG | - | AGUAAACAUAACCCCAAAAA | 5350 |
| GGGTTATGTTTACTATACAA | 2257 | AGG | + | GGGUUAUGUUUACUAUACAA | 5351 |
| TTATGTTTACTATACAAAGG | 2258 | TGG | + | UUAUGUUUACUAUACAAAGG | 5352 |
| GTTTACTATACAAAGGTGGA | 2259 | AGG | + | GUUUACUAUACAAAGGUGGA | 5353 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| TTTACTATACAAAGGTGGAA | 2260 | GGG | + | UUUACUAUACAAAGGUGGAA | 5354 |
| TTACTATACAAAGGTGGAAG | 2261 | GGG | + | UUACUAUACAAAGGUGGAAG | 5355 |
| CAAAGGTGGAAGGGGTTATC | 2262 | TGG | + | CAAAGGUGGAAGGGGUUAUC | 5356 |
| GTTATCTGGCCCCATCTTAC | 2263 | AGG | + | GUUAUCUGGCCCCAUCUUAC | 5357 |
| ACACAGTTACCTGTAAGATG | 2264 | GGG | - | ACACAGUUACCUGUAAGAUG | 5358 |
| GACACAGTTACCTGTAAGAT | 2265 | GGG | - | GACACAGUUACCUGUAAGAU | 5359 |
| GGACACAGTTACCTGTAAGA | 2266 | TGG | - | GGACACAGUUACCUGUAAGA | 5360 |
| AGGTAACTGTGTCCCTTTTG | 2267 | TGG | + | AGGUAACUGUGUCCCUUUUG | 5361 |
| TGGTTTTTATATCCACAAAA | 2268 | GGG | - | UGGUUUUUAUAUCCACAAAA | 5362 |
| ATGGTTTTTATATCCACAAA | 2269 | AGG | - | AUGGUUUUUAUAUCCACAAA | 5363 |
| AATAAAATTGCAGTATCTGA | 2270 | TGG | - | AAUAAAAUUGCAGUAUCUGA | 5364 |
| TATTTTTGATTATGTGTCTG | 2271 | AGG | + | UAUUUUUGAUUAUGUGUCUG | 5365 |
| ATTTTTGATTATGTGTCTGA | 2272 | GGG | + | AUUUUUGAUUAUGUGUCUGA | 5366 |
| CAGTATGCACATCTGCATGC | 2273 | AGG | + | CAGUAUGCACAUCUGCAUGC | 5367 |
| CATCTGCATGCAGGTGCCTG | 2274 | TGG | + | CAUCUGCAUGCAGGUGCCUG | 5368 |
| CAGGTGCCTGTGGAAGCCTG | 2275 | TGG | + | CAGGUGCCUGUGGAAGCCUG | 5369 |
| ATGTCTCCACAGGCTTCCAC | 2276 | AGG | - | AUGUCUCCACAGGCUUCCAC | 5370 |
| AGGTGATCTGATGTCTCCAC | 2277 | AGG | - | AGGUGAUCUGAUGUCUCCAC | 5371 |
| GACATCAGATCACCTGAAGC | 2278 | TGG | + | GACAUCAGAUCACCUGAAGC | 5372 |
| TCACCTGAAGCTGGAGTTTC | 2279 | AGG | + | UCACCUGAAGCUGGAGUUUC | 5373 |
| CTGCCTGAAACTCCAGCTTC | 2280 | AGG | - | CUGCCUGAAACUCCAGCUUC | 5374 |
| AGTTTTATGCCACCAGACAC | 2281 | TGG | + | AGUUUUAUGCCACCAGACAC | 5375 |
| TTCTCAGCACCAGTGTCTGG | 2282 | TGG | - | UUCUCAGCACCAGUGUCUGG | 5376 |
| CTATTCTCAGCACCAGTGTC | 2283 | TGG | - | CUAUUCUCAGCACCAGUGUC | 5377 |
| ATAAAATATACTGCTTTTGC | 2284 | AGG | - | AUAAAAUAUACUGCUUUUGC | 5378 |
| GTTGCTTTTGGCTGGAGAGA | 2285 | TGG | - | GUUGCUUUUGGCUGGAGAGA | 5379 |
| TTTTAAAGGTTGCTTTTGGC | 2286 | TGG | - | UUUUAAAGGUUGCUUUUGGC | 5380 |
| CAGCTTTTAAAGGTTGCTTT | 2287 | TGG | - | CAGCUUUUAAAGGUUGCUUU | 5381 |
| AAAGCAACCTTTAAAAGCTG | 2288 | TGG | + | AAAGCAACCUUUAAAAGCUG | 5382 |
| ACATAAACCACAGCTTTTAA | 2289 | AGG | - | ACAUAAACCACAGCUUUUAA | 5383 |
| CTCTAAGTGGATGAATTAAA | 2290 | TGG | - | CUCUAAGUGGAUGAAUUAAA | 5384 |
| CATTTAATTCATCCACTTAG | 2291 | AGG | + | CAUUUAAUUCAUCCACUUAG | 5385 |
| ATTTAATTCATCCACTTAGA | 2292 | GGG | + | AUUUAAUUCAUCCACUUAGA | 5386 |
| ATTGAAGTGTACCCTCTAAG | 2293 | TGG | - | AUUGAAGUGUACCCUCUAAG | 5387 |
| AAAATATGCTTACAGATCTG | 2294 | TGG | + | AAAAUAUGCUUACAGAUCUG | 5388 |
| AAATATGCTTACAGATCTGT | 2295 | GGG | + | AAAUAUGCUUACAGAUCUGU | 5389 |
| TGCTAAAAGGGTTCTAAAAT | 2296 | TGG | - | UGCUAAAAGGGUUCUAAAAU | 5390 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| TAATATCTGTAGTGCTAAAA | 2297 | GGG | - | UAAUAUCUGUAGUGCUAAAA | 5391 |
| TTAATATCTGTAGTGCTAAA | 2298 | AGG | - | UUAAUAUCUGUAGUGCUAAA | 5392 |
| GCTGGGGGCTGGGGAGAATA | 2299 | GGG | - | GCUGGGGGCUGGGGAGAAUA | 5393 |
| AGCTGGGGGCTGGGGAGAAT | 2300 | AGG | - | AGCUGGGGGCUGGGGAGAAU | 5394 |
| GGGACTGGAGCTGGGGGCTG | 2301 | GGG | - | GGGACUGGAGCUGGGGGCUG | 5395 |
| AGGGACTGGAGCTGGGGGCT | 2302 | GGG | - | AGGGACUGGAGCUGGGGGCU | 5396 |
| CAGGGACTGGAGCTGGGGGC | 2303 | TGG | - | CAGGGACUGGAGCUGGGGGC | 5397 |
| CAGCCCCCAGCTCCAGTCCC | 2304 | TGG | + | CAGCCCCCAGCUCCAGUCCC | 5398 |
| ATGCCAGGGACTGGAGCTGG | 2305 | GGG | - | AUGCCAGGGACUGGAGCUGG | 5399 |
| GATGCCAGGGACTGGAGCTG | 2306 | GGG | - | GAUGCCAGGGACUGGAGCUG | 5400 |
| GGATGCCAGGGACTGGAGCT | 2307 | GGG | - | GGAUGCCAGGGACUGGAGCU | 5401 |
| TGGATGCCAGGGACTGGAGC | 2308 | TGG | - | UGGAUGCCAGGGACUGGAGC | 5402 |
| GATTTGTGGATGCCAGGGAC | 2309 | TGG | - | GAUUUGUGGAUGCCAGGGAC | 5403 |
| AAGGGGATTTGTGGATGCCA | 2310 | GGG | - | AAGGGGAUUUGUGGAUGCCA | 5404 |
| GAAGGGGATTTGTGGATGCC | 2311 | AGG | - | GAAGGGGAUUUGUGGAUGCC | 5405 |
| GATGGCAGGAAGGGGATTTG | 2312 | TGG | - | GAUGGCAGGAAGGGGAUUUG | 5406 |
| AATCTATAGATGGCAGGAAG | 2313 | GGG | - | AAUCUAUAGAUGGCAGGAAG | 5407 |
| GAATCTATAGATGGCAGGAA | 2314 | GGG | - | GAAUCUAUAGAUGGCAGGAA | 5408 |
| TGAATCTATAGATGGCAGGA | 2315 | AGG | - | UGAAUCUAUAGAUGGCAGGA | 5409 |
| GAGGTGAATCTATAGATGGC | 2316 | AGG | - | GAGGUGAAUCUAUAGAUGGC | 5410 |
| AGAAGAGGTGAATCTATAGA | 2317 | TGG | - | AGAAGAGGUGAAUCUAUAGA | 5411 |
| TTCAGTGTAAAGTCTAGAAG | 2318 | AGG | - | UUCAGUGUAAAGUCUAGAAG | 5412 |
| TTCTAGACTTTACACTGAAA | 2319 | TGG | + | UUCUAGACUUUACACUGAAA | 5413 |
| AAATGGTATTACACAACATG | 2320 | TGG | + | AAAUGGUAUUACACAACAUG | 5414 |
| TTGCTTGCCGTGTGTCTGTG | 2321 | AGG | + | UUGCUUGCCGUGUGUCUGUG | 5415 |
| AGATGAACCTCACAGACACA | 2322 | CGG | - | AGAUGAACCUCACAGACACA | 5416 |
| TCATCTGTGTTGAGCATGAA | 2323 | AGG | + | UCAUCUGUGUUGAGCAUGAA | 5417 |
| TAGGCGACAGGCATATTCAT | 2324 | GGG | - | UAGGCGACAGGCAUAUUCAU | 5418 |
| TTAGGCGACAGGCATATTCA | 2325 | TGG | - | UUAGGCGACAGGCAUAUUCA | 5419 |
| GTGTTGCTATTTTAGGCGAC | 2326 | AGG | - | GUGUUGCUAUUUUAGGCGAC | 5420 |
| TGTGAAAGTGTTGCTATTTT | 2327 | AGG | - | UGUGAAAGUGUUGCUAUUUU | 5421 |
| CCTTCTTTCTTCTTCCCAAG | 2328 | AGG | + | CCUUCUUUCUUCUUCCCAAG | 5422 |
| CCTCTTGGGAAGAAGAAAGA | 2329 | AGG | - | CCUCUUGGGAAGAAGAAAGA | 5423 |
| CTTCTTTCTTCTTCCCAAGA | 2330 | GGG | + | CUUCUUUCUUCUUCCCAAGA | 5424 |
| GCTGCAATAATGTCCCTCTT | 2331 | GGG | - | GCUGCAAUAAUGUCCCUCUU | 5425 |
| GGCTGCAATAATGTCCCTCT | 2332 | TGG | - | GGCUGCAAUAAUGUCCCUCU | 5426 |
| AGACACAGGAGAAAACTAGC | 2333 | AGG | - | AGACACAGGAGAAAACUAGC | 5427 |
| AGAAACACGAAAAAGACAC | 2334 | AGG | - | AGAAACACGAAAAAGACAC | 5428 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| CGTGTTTCTCAAGTAGATGA | 2335 | AGG | + | CGUGUUUCUCAAGUAGAUGA | 5429 |
| GTGTTTCTCAAGTAGATGAA | 2336 | GGG | + | GUGUUUCUCAAGUAGAUGAA | 5430 |
| TCTCAAGTAGATGAAGGGAC | 2337 | TGG | + | UCUCAAGUAGAUGAAGGGAC | 5431 |
| TTAGGAAACTGACAAAGCAG | 2338 | GGG | - | UUAGGAAACUGACAAAGCAG | 5432 |
| TTTAGGAAACTGACAAAGCA | 2339 | GGG | - | UUUAGGAAACUGACAAAGCA | 5433 |
| ATTTAGGAAACTGACAAAGC | 2340 | AGG | - | AUUUAGGAAACUGACAAAGC | 5434 |
| AATACAGTATTCACTCATTT | 2341 | AGG | - | AAUACAGUAUUCACUCAUUU | 5435 |
| AAATGAGTGAATACTGTATT | 2342 | TGG | + | AAAUGAGUGAAUACUGUAUU | 5436 |
| TATTTTGGTCTTTCTGATTG | 2343 | GGG | - | UAUUUUGGUCUUUCUGAUUG | 5437 |
| TTATTTTGGTCTTTCTGATT | 2344 | GGG | - | UUAUUUUGGUCUUUCUGAUU | 5438 |
| ATTATTTTGGTCTTTCTGAT | 2345 | TGG | - | AUUAUUUUGGUCUUUCUGAU | 5439 |
| GAGATTATTTTAAATTATTT | 2346 | TGG | - | GAGAUUAUUUUAAAUUAUUU | 5440 |
| ATCTCGTCTCTATATCACTA | 2347 | AGG | + | AUCUCGUCUCUAUAUCACUA | 5441 |
| CTAAGGTATCCTTTTCCACT | 2348 | TGG | + | CUAAGGUAUCCUUUUCCACU | 5442 |
| TAAGGTATCCTTTTCCACTT | 2349 | GGG | + | UAAGGUAUCCUUUUCCACUU | 5443 |
| CTGCATGGCCCAAGTGGAAA | 2350 | AGG | - | CUGCAUGGCCCAAGUGGAAA | 5444 |
| ATTTCTCTGCATGGCCCAAG | 2351 | TGG | - | AUUUCUCUGCAUGGCCCAAG | 5445 |
| GGCATGCTTATTTCTCTGCA | 2352 | TGG | - | GGCAUGCUUAUUUCUCUGCA | 5446 |
| GGGTGGGGTGGGGTCAATCA | 2353 | AGG | - | GGGUGGGGUGGGGUCAAUCA | 5447 |
| CTGGGGGTTGGGGTGGGGTG | 2354 | GGG | - | CUGGGGGUUGGGGUGGGGUG | 5448 |
| ACTGGGGGTTGGGGTGGGGT | 2355 | GGG | - | ACUGGGGGUUGGGGUGGGGU | 5449 |
| CACTGGGGGTTGGGGTGGGG | 2356 | TGG | - | CACUGGGGGUUGGGGUGGGG | 5450 |
| CACCCCACCCCAACCCCCAG | 2357 | TGG | + | CACCCCACCCCAACCCCCAG | 5451 |
| CACCACTGGGGGTTGGGGTG | 2358 | GGG | - | CACCACUGGGGGUUGGGGUG | 5452 |
| TCACCACTGGGGGTTGGGGT | 2359 | GGG | - | UCACCACUGGGGGUUGGGGU | 5453 |
| GTCACCACTGGGGGTTGGGG | 2360 | TGG | - | GUCACCACUGGGGGUUGGGG | 5454 |
| CTTGTCACCACTGGGGGTTG | 2361 | GGG | - | CUUGUCACCACUGGGGGUUG | 5455 |
| CCCAACCCCCAGTGGTGACA | 2362 | AGG | + | CCCAACCCCCAGUGGUGACA | 5456 |
| CCTTGTCACCACTGGGGGTT | 2363 | GGG | - | CCUUGUCACCACUGGGGGUU | 5457 |
| TCCTTGTCACCACTGGGGGT | 2364 | TGG | - | UCCUUGUCACCACUGGGGGU | 5458 |
| GAGGTCCTTGTCACCACTGG | 2365 | GGG | - | GAGGUCCUUGUCACCACUGG | 5459 |
| GGAGGTCCTTGTCACCACTG | 2366 | GGG | - | GGAGGUCCUUGUCACCACUG | 5460 |
| GGGAGGTCCTTGTCACCACT | 2367 | GGG | - | GGGAGGUCCUUGUCACCACU | 5461 |
| GGGGAGGTCCTTGTCACCAC | 2368 | TGG | - | GGGGAGGUCCUUGUCACCAC | 5462 |
| GGTGACAAGGACCTCCCCAG | 2369 | CGG | + | GGUGACAAGGACCUCCCCAG | 5463 |
| AAATGGTTGAGCCGCTGGGG | 2370 | AGG | - | AAAUGGUUGAGCCGCUGGGG | 5464 |
| TTCAAATGGTTGAGCCGCTG | 2371 | GGG | - | UUCAAAUGGUUGAGCCGCUG | 5465 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| ATTCAAATGGTTGAGCCGCT | 2372 | GGG | - | AUUCAAAUGGUUGAGCCGCU | 5466 |
| TATTCAAATGGTTGAGCCGC | 2373 | TGG | - | UAUUCAAAUGGUUGAGCCGC | 5467 |
| GCTCAACCATTTGAATAAAA | 2374 | AGG | + | GCUCAACCAUUUGAAUAAAA | 5468 |
| AAGTGTCCTTTTTATTCAAA | 2375 | TGG | - | AAGUGUCCUUUUUAUUCAAA | 5469 |
| ATCTTAGATTTGTGCAAAAT | 2376 | GGG | - | AUCUUAGAUUUGUGCAAAAU | 5470 |
| CATCTTAGATTTGTGCAAAA | 2377 | TGG | - | CAUCUUAGAUUUGUGCAAAA | 5471 |
| ACAAATCTAAGATGAGCAAG | 2378 | TGG | + | ACAAAUCUAAGAUGAGCAAG | 5472 |
| GTCACCTGTAAACATGTGCC | 2379 | TGG | + | GUCACCUGUAAACAUGUGCC | 5473 |
| TGCTCCAGGCACATGTTTAC | 2380 | AGG | - | UGCUCCAGGCACAUGUUUAC | 5474 |
| GTAAACATGTGCCTGGAGCA | 2381 | CGG | + | GUAAACAUGUGCCUGGAGCA | 5475 |
| CTCAGGTCGTTCCGTGCTCC | 2382 | AGG | - | CUCAGGUCGUUCCGUGCUCC | 5476 |
| GAGCACGGAACGACCTGAGT | 2383 | AGG | + | GAGCACGGAACGACCUGAGU | 5477 |
| CGACCTGAGTAGGCAGAAAA | 2384 | AGG | + | CGACCUGAGUAGGCAGAAAA | 5478 |
| CCTGAGTAGGCAGAAAAAGG | 2385 | TGG | + | CCUGAGUAGGCAGAAAAAGG | 5479 |
| CCACCTTTTTCTGCCTACTC | 2386 | AGG | - | CCACCUUUUUCUGCCUACUC | 5480 |
| ATTTATGATTTTCTTTTAA | 2387 | AGG | + | AUUUAUGAUUUUCUUUUAA | 5481 |
| AGTGAGAAAGGTGGGGAAA | 2388 | TGG | - | AGUGAGAAAGGUGGGGAAA | 5482 |
| TTGGAAAGTGAGAAAGGTGG | 2389 | GGG | - | UUGGAAAGUGAGAAAGGUGG | 5483 |
| GTTGGAAAGTGAGAAAGGTG | 2390 | GGG | - | GUUGGAAAGUGAGAAAGGUG | 5484 |
| TGTTGGAAAGTGAGAAAGGT | 2391 | GGG | - | UGUUGGAAAGUGAGAAAGGU | 5485 |
| TTGTTGGAAAGTGAGAAAGG | 2392 | TGG | - | UUGUUGGAAAGUGAGAAAGG | 5486 |
| ATATTGTTGGAAAGTGAGAA | 2393 | AGG | - | AUAUUGUUGGAAAGUGAGAA | 5487 |
| TTTCCAACAATATTATATTC | 2394 | TGG | + | UUUCCAACAAUAUUAUAUUC | 5488 |
| ACACCAGAATATAATATTGT | 2395 | TGG | - | ACACCAGAAUAUAAUAUUGU | 5489 |
| CTTTTATTCCCCAGTTGTTT | 2396 | TGG | + | CUUUUAUUCCCCAGUUGUUU | 5490 |
| TTTAATCACCAAAACAACTG | 2397 | GGG | - | UUUAAUCACCAAAACAACUG | 5491 |
| ATTTAATCACCAAAACAACT | 2398 | GGG | - | AUUUAAUCACCAAAACAACU | 5492 |
| GATTTAATCACCAAAACAAC | 2399 | TGG | - | GAUUUAAUCACCAAAACAAC | 5493 |
| TTTTGGTGATTAAATCATTT | 2400 | TGG | + | UUUUGGUGAUUAAAUCAUUU | 5494 |
| TTTGGTGATTAAATCATTTT | 2401 | GGG | + | UUUGGUGAUUAAAUCAUUUU | 5495 |
| TTGGTGATTAAATCATTTTG | 2402 | GGG | + | UUGGUGAUUAAAUCAUUUUG | 5496 |
| TGGTGATTAAATCATTTTGG | 2403 | GGG | + | UGGUGAUUAAAUCAUUUUGG | 5497 |
| ACTCTCATTCACTGCTCCCT | 2404 | TGG | + | ACUCUCAUUCACUGCUCCCU | 5498 |
| AAAAAAACACTGTCACCAA | 2405 | GGG | - | AAAAAAACACUGUCACCAA | 5499 |
| GAAAAAAACACTGTCACCA | 2406 | AGG | - | GAAAAAAACACUGUCACCA | 5500 |
| GCAGAGACAGAGGGAACAGC | 2407 | AGG | - | GCAGAGACAGAGGGAACAGC | 5501 |
| TGAAAATGAGCAGAGACAGA | 2408 | GGG | - | UGAAAAUGAGCAGAGACAGA | 5502 |
| ATGAAAATGAGCAGAGACAG | 2409 | AGG | - | AUGAAAAUGAGCAGAGACAG | 5503 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| CTGTCTCTGCTCATTTTCAT | 2410 | AGG | + | CUGUCUCUGCUCAUUUUCAU | 5504 |
| TGCTCATTTTCATAGGAATC | 2411 | TGG | + | UGCUCAUUUUCAUAGGAAUC | 5505 |
| ATCTGGCACCTTAGAATCCC | 2412 | AGG | + | AUCUGGCACCUUAGAAUCCC | 5506 |
| GCAGGCAGCCTGGGATTCTA | 2413 | AGG | - | GCAGGCAGCCUGGGAUUCUA | 5507 |
| CATTTGACTGCAGGCAGCCT | 2414 | GGG | - | CAUUUGACUGCAGGCAGCCU | 5508 |
| GCATTTGACTGCAGGCAGCC | 2415 | TGG | - | GCAUUUGACUGCAGGCAGCC | 5509 |
| CCTGCAGTCAAATGCTTGCT | 2416 | AGG | + | CCUGCAGUCAAAUGCUUGCU | 5510 |
| CCTAGCAAGCATTTGACTGC | 2417 | AGG | - | CCUAGCAAGCAUUUGACUGC | 5511 |
| CTGCAGTCAAATGCTTGCTA | 2418 | GGG | + | CUGCAGUCAAAUGCUUGCUA | 5512 |
| CAGTCAAATGCTTGCTAGGG | 2419 | AGG | + | CAGUCAAAUGCUUGCUAGGG | 5513 |
| AGTCAAATGCTTGCTAGGGA | 2420 | GGG | + | AGUCAAAUGCUUGCUAGGGA | 5514 |
| GTCAAATGCTTGCTAGGGAG | 2421 | GGG | + | GUCAAAUGCUUGCUAGGGAG | 5515 |
| TTGCTAGGGAGGGGAGCCAG | 2422 | TGG | + | UUGCUAGGGAGGGGAGCCAG | 5516 |
| TGCTAGGGAGGGGAGCCAGT | 2423 | GGG | + | UGCUAGGGAGGGGAGCCAGU | 5517 |
| TAGGGAGGGGAGCCAGTGGG | 2424 | TGG | + | UAGGGAGGGGAGCCAGUGGG | 5518 |
| AGGGAGGGGAGCCAGTGGGT | 2425 | GGG | + | AGGGAGGGGAGCCAGUGGGU | 5519 |
| GGGAGGGGAGCCAGTGGGTG | 2426 | GGG | + | GGGAGGGGAGCCAGUGGGUG | 5520 |
| GGAGGGGAGCCAGTGGGTGG | 2427 | GGG | + | GGAGGGGAGCCAGUGGGUGG | 5521 |
| TTGCAGGTTCCCCCACCCAC | 2428 | TGG | - | UUGCAGGUUCCCCCACCCAC | 5522 |
| ATTTGGAGTTGATTTCTTGC | 2429 | AGG | - | AUUUGGAGUUGAUUUCUUGC | 5523 |
| AAATCAACTCCAAATTTAAT | 2430 | AGG | + | AAAUCAACUCCAAAUUUAAU | 5524 |
| GAGCTTAGTCCTATTAAATT | 2431 | TGG | - | GAGCUUAGUCCUAUUAAAUU | 5525 |
| CTGCTAATCAGGCATGGTGT | 2432 | AGG | - | CUGCUAAUCAGGCAUGGUGU | 5526 |
| ACCATGCCTGATTAGCAGCT | 2433 | AGG | + | ACCAUGCCUGAUUAGCAGCU | 5527 |
| ACCTAGCTGCTAATCAGGCA | 2434 | TGG | - | ACCUAGCUGCUAAUCAGGCA | 5528 |
| ATGAGACCTAGCTGCTAATC | 2435 | AGG | - | AUGAGACCUAGCUGCUAAUC | 5529 |
| GGTCTCATCCTTACCCCTCC | 2436 | AGG | + | GGUCUCAUCCUUACCCCUCC | 5530 |
| TCCTTACCCCTCCAGGAATA | 2437 | AGG | + | UCCUUACCCCUCCAGGAAUA | 5531 |
| TCCTTATTCCTGGAGGGGTA | 2438 | AGG | - | UCCUUAUUCCUGGAGGGGUA | 5532 |
| TACCCCTCCAGGAATAAGGA | 2439 | AGG | + | UACCCCUCCAGGAAUAAGGA | 5533 |
| AACCTTCCTTATTCCTGGAG | 2440 | GGG | - | AACCUUCCUUAUUCCUGGAG | 5534 |
| CAACCTTCCTTATTCCTGGA | 2441 | GGG | - | CAACCUUCCUUAUUCCUGGA | 5535 |
| GCAACCTTCCTTATTCCTGG | 2442 | AGG | - | GCAACCUUCCUUAUUCCUGG | 5536 |
| TCTGCAACCTTCCTTATTCC | 2443 | TGG | - | UCUGCAACCUUCCUUAUUCC | 5537 |
| AGGTTGCAGAAGTCCCTGAA | 2444 | AGG | + | AGGUUGCAGAAGUCCCUGAA | 5538 |
| GGCTCAGCAAATACCTTTCA | 2445 | GGG | - | GGCUCAGCAAAUACCUUUCA | 5539 |
| AGGCTCAGCAAATACCTTTC | 2446 | AGG | - | AGGCUCAGCAAAUACCUUUC | 5540 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| GCTGAGCCTCTTGTGAACCG | 2447 | TGG | + | GCUGAGCCUCUUGUGAACCG | 5541 |
| CTGAGCCTCTTGTGAACCGT | 2448 | GGG | + | CUGAGCCUCUUGUGAACCGU | 5542 |
| GCCTCTTGTGAACCGTGGGT | 2449 | TGG | + | GCCUCUUGUGAACCGUGGGU | 5543 |
| GCCAACCCACGGTTCACAAG | 2450 | AGG | - | GCCAACCCACGGUUCACAAG | 5544 |
| AGTTCAGGTGAGCCAACCCA | 2451 | CGG | - | AGUUCAGGUGAGCCAACCCA | 5545 |
| AAGAATATCTACTAAAGTTC | 2452 | AGG | - | AAGAAUAUCUACUAAAGUUC | 5546 |
| ATATTCTTTAGCGACATATT | 2453 | TGG | + | AUAUUCUUUAGCGACAUAUU | 5547 |
| TATTCTTTAGCGACATATTT | 2454 | GGG | + | UAUUCUUUAGCGACAUAUUU | 5548 |
| TTAGCGACATATTTGGGCTT | 2455 | TGG | + | UUAGCGACAUAUUUGGGCUU | 5549 |
| TGTGGAGAGATAAAGAGAG | 2456 | AGG | - | UGUGGAGAGAUAAAGAGAG | 5550 |
| TTATCTCTCCACAAAAGTCT | 2457 | TGG | + | UUAUCUCUCCACAAAAGUCU | 5551 |
| TCAGTTTGCCAAGACTTTTG | 2458 | TGG | - | UCAGUUUGCCAAGACUUUUG | 5552 |
| TGATGTTTATGCAACCAGTA | 2459 | AGG | + | UGAUGUUUAUGCAACCAGUA | 5553 |
| TATGCAACCAGTAAGGCCTC | 2460 | TGG | + | UAUGCAACCAGUAAGGCCUC | 5554 |
| ATGCAACCAGTAAGGCCTCT | 2461 | GGG | + | AUGCAACCAGUAAGGCCUCU | 5555 |
| TGCAACCAGTAAGGCCTCTG | 2462 | GGG | + | UGCAACCAGUAAGGCCUCUG | 5556 |
| CTCAGCCCCAGAGGCCTTAC | 2463 | TGG | - | CUCAGCCCCAGAGGCCUUAC | 5557 |
| CAGTAAGGCCTCTGGGCTG | 2464 | AGG | + | CAGUAAGGCCUCUGGGCUG | 5558 |
| AGTAAGGCCTCTGGGCTGA | 2465 | GGG | + | AGUAAGGCCUCUGGGCUGA | 5559 |
| GTAAGGCCTCTGGGCTGAG | 2466 | GGG | + | GUAAGGCCUCUGGGCUGAG | 5560 |
| TAAGGCCTCTGGGCTGAGG | 2467 | GGG | + | UAAGGCCUCUGGGCUGAGG | 5561 |
| GGCCTCTGGGCTGAGGGGG | 2468 | TGG | + | GGCCUCUGGGCUGAGGGGG | 5562 |
| GCCTCTGGGCTGAGGGGGT | 2469 | GGG | + | GCCUCUGGGCUGAGGGGGU | 5563 |
| TCCCACCCCCTCAGCCCCAG | 2470 | AGG | - | UCCCACCCCCUCAGCCCCAG | 5564 |
| CTGAGGGGGTGGGAAGCCAG | 2471 | TGG | + | CUGAGGGGGUGGGAAGCCAG | 5565 |
| TGAGGGGGTGGGAAGCCAGT | 2472 | GGG | + | UGAGGGGGUGGGAAGCCAGU | 5566 |
| GGGGGTGGGAAGCCAGTGGG | 2473 | TGG | + | GGGGGUGGGAAGCCAGUGGG | 5567 |
| GGTGGGAAGCCAGTGGGTGG | 2474 | CGG | + | GGUGGGAAGCCAGUGGGUGG | 5568 |
| TTGCAGGTTCCGCCACCCAC | 2475 | TGG | - | UUGCAGGUUCCGCCACCCAC | 5569 |
| ATTTGGGGCGGATTTCTTGC | 2476 | AGG | - | AUUUGGGGCGGAUUUCUUGC | 5570 |
| AGAAATCCGCCCCAAATTTA | 2477 | AGG | + | AGAAAUCCGCCCCAAAUUUA | 5571 |
| ATGCTTCCTTAAATTTGGGG | 2478 | CGG | - | AUGCUUCCUUAAAUUUGGGG | 5572 |
| CCCCAAATTTAAGGAAGCAT | 2479 | AGG | + | CCCCAAAUUUAAGGAAGCAU | 5573 |
| CCTATGCTTCCTTAAATTTG | 2480 | GGG | - | CCUAUGCUUCCUUAAAUUUG | 5574 |
| TCCTATGCTTCCTTAAATTT | 2481 | GGG | - | UCCUAUGCUUCCUUAAAUUU | 5575 |
| TTCCTATGCTTCCTTAAATT | 2482 | TGG | - | UUCCUAUGCUUCCUUAAAUU | 5576 |
| CCTACCCTATGTCTGCCTTG | 2483 | TGG | + | CCUACCCUAUGUCUGCCUUG | 5577 |
| CCACAAGGCAGACATAGGGT | 2484 | AGG | - | CCACAAGGCAGACAUAGGGU | 5578 |

TABLE 3-continued

Mouse Rs1 Intron 1 Guide RNA Target Sequences and Guide Sequences.

| Target | SEQ ID NO. | PAM | Direction | Guide | SEQ ID NO. |
| --- | --- | --- | --- | --- | --- |
| CTAGCCACAAGGCAGACATA | 2485 | GGG | - | CUAGCCACAAGGCAGACAUA | 5579 |
| CCTATGTCTGCCTTGTGGCT | 2486 | AGG | + | CCUAUGUCUGCCUUGUGGCU | 5580 |
| CCTAGCCACAAGGCAGACAT | 2487 | AGG | - | CCUAGCCACAAGGCAGACAU | 5581 |
| GAACTAAGGACCTAGCCACA | 2488 | AGG | - | GAACUAAGGACCUAGCCACA | 5582 |
| TCCTTAGTTCATTGTCTCTT | 2489 | AGG | + | UCCUUAGUUCAUUGUCUCUU | 5583 |
| ACCTAAGAGACAATGAACTA | 2490 | AGG | - | ACCUAAGAGACAAUGAACUA | 5584 |
| TTCTACTCTCAAGAGAATCT | 2491 | GGG | - | UUCUACUCUCAAGAGAAUCU | 5585 |
| CTTCTACTCTCAAGAGAATC | 2492 | TGG | - | CUUCUACUCUCAAGAGAAUC | 5586 |
| CAGATTCTCTTGAGAGTAGA | 2493 | AGG | + | CAGAUUCUCUUGAGAGUAGA | 5587 |
| ATTCTCTTGAGAGTAGAAGG | 2494 | TGG | + | AUUCUCUUGAGAGUAGAAGG | 5588 |
| TCTCGGATTTGTTAATCAGG | 2495 | AGG | - | UCUCGGAUUUGUUAAUCAGG | 5589 |
| TCCTGATTAACAAATCCGAG | 2496 | AGG | + | UCCUGAUUAACAAAUCCGAG | 5590 |
| ACCTCTCGGATTTGTTAATC | 2497 | AGG | - | ACCUCUCGGAUUUGUUAAUC | 5591 |
| TTCATGAGATTAGCACCTCT | 2498 | CGG | - | UUCAUGAGAUUAGCACCUCU | 5592 |
| GCTAATCTCATGAATTCTCC | 2499 | CGG | + | GCUAAUCUCAUGAAUUCUCC | 5593 |
| TCATGAATTCTCCCGGACTA | 2500 | TGG | + | UCAUGAAUUCUCCCGGACUA | 5594 |
| GCTATATATAACCATAGTCC | 2501 | GGG | - | GCUAUAUAUAACCAUAGUCC | 5595 |
| AGCTATATATAACCATAGTC | 2502 | CGG | - | AGCUAUAUAUAACCAUAGUC | 5596 |
| TCAGTGATCTCATGTAGCTT | 2503 | AGG | + | UCAGUGAUCUCAUGUAGCUU | 5597 |
| TGATCTCATGTAGCTTAGGC | 2504 | TGG | + | UGAUCUCAUGUAGCUUAGGC | 5598 |
| CTCATGTAGCTTAGGCTGGC | 2505 | TGG | + | CUCAUGUAGCUUAGGCUGGC | 5599 |
| TTGAGCTCACTATGAAGCAA | 2506 | AGG | + | UUGAGCUCACUAUGAAGCAA | 5600 |
| AAGGATGACCCTGAACTTCT | 2507 | TGG | + | AAGGAUGACCCUGAACUUCU | 5601 |
| CAGGAAAACCAAGAAGTTCA | 2508 | GGG | - | CAGGAAAACCAAGAAGUUCA | 5602 |
| GCAGGAAAACCAAGAAGTTC | 2509 | AGG | - | GCAGGAAAACCAAGAAGUUC | 5603 |
| AGCACTTGGAAGATGAAAGC | 2510 | AGG | - | AGCACUUGGAAGAUGAAAGC | 5604 |
| ATTCTTGTAATCGCAGCACT | 2511 | TGG | - | AUUCUUGUAAUCGCAGCACU | 5605 |
| GCTGCCATGTCTAGTTCATG | 2512 | TGG | + | GCUGCCAUGUCUAGUUCAUG | 5606 |
| AGCACCACATGAACTAGACA | 2513 | TGG | - | AGCACCACAUGAACUAGACA | 5607 |
| TGTCTAGTTCATGTGGTGCT | 2514 | AGG | + | UGUCUAGUUCAUGUGGUGCU | 5608 |
| GTCTAGTTCATGTGGTGCTA | 2515 | GGG | + | GUCUAGUUCAUGUGGUGCUA | 5609 |
| GGTGCTAGGGATCAACCCTG | 2516 | AGG | + | GGUGCUAGGGAUCAACCCUG | 5610 |
| TTAACATGCACAAAGCCTCA | 2517 | GGG | - | UUAACAUGCACAAAGCCUCA | 5611 |
| CTTAACATGCACAAAGCCTC | 2518 | AGG | - | CUUAACAUGCACAAAGCCUC | 5612 |
| ATTCTTTTGAGTCAGGGTCA | 2519 | GGG | - | AUUCUUUUGAGUCAGGGUCA | 5613 |
| TATTCTTTTGAGTCAGGGTC | 2520 | AGG | - | UAUUCUUUUGAGUCAGGGUC | 5614 |
| TGACCCTGACTCAAAAGAAT | 2521 | AGG | + | UGACCCUGACUCAAAAGAAU | 5615 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| GACCCTGACTCAAAAGAATA | 2522 | GGG | + | GACCCUGACUCAAAAGAAUA | 5616 |
| ACCCTGACTCAAAAGAATAG | 2523 | GGG | + | ACCCUGACUCAAAAGAAUAG | 5617 |
| CCCTGACTCAAAAGAATAGG | 2524 | GGG | + | CCCUGACUCAAAAGAAUAGG | 5618 |
| CCCCCTATTCTTTTGAGTCA | 2525 | GGG | - | CCCCCUAUUCUUUUGAGUCA | 5619 |
| CCTGACTCAAAAGAATAGGG | 2526 | GGG | + | CCUGACUCAAAAGAAUAGGG | 5620 |
| CCCCCCTATTCTTTTGAGTC | 2527 | AGG | - | CCCCCCUAUUCUUUUGAGUC | 5621 |
| CTGACTCAAAAGAATAGGGG | 2528 | GGG | + | CUGACUCAAAAGAAUAGGGG | 5622 |
| ACTCAAAAGAATAGGGGGGG | 2529 | AGG | + | ACUCAAAAGAAUAGGGGGGG | 5623 |
| AAAAGAATAGGGGGGGAGGA | 2530 | AGG | + | AAAAGAAUAGGGGGGGAGGA | 5624 |
| GAATAGGGGGGAGGAAGGA | 2531 | AGG | + | GAAUAGGGGGGAGGAAGGA | 5625 |
| AGGGGGGAGGAAGGAAGGA | 2532 | AGG | + | AGGGGGGAGGAAGGAAGGA | 5626 |
| GGGGAGGAAGGAAGGAAGGA | 2533 | AGG | + | GGGGAGGAAGGAAGGAAGGA | 5627 |
| AGGAAGGAAGGAAGGAAGGA | 2534 | AGG | + | AGGAAGGAAGGAAGGAAGGA | 5628 |
| AGGAAGGAAGGAAGGAAGGA | 2535 | AGG | + | AGGAAGGAAGGAAGGAAGGA | 5629 |
| GGAAGGAAGGAAGGAAGGAA | 2536 | GGG | + | GGAAGGAAGGAAGGAAGGAA | 5630 |
| AGGAAGGAAGGAAGGAAGGG | 2537 | AGG | + | AGGAAGGAAGGAAGGAAGGG | 5631 |
| GGAAGGAAGGAAGGAAGGGA | 2538 | GGG | + | GGAAGGAAGGAAGGAAGGGA | 5632 |
| AGGAAGGAAGGAAGGGAGGG | 2539 | AGG | + | AGGAAGGAAGGAAGGGAGGG | 5633 |
| GGAAGGAAGGAAGGGAGGGA | 2540 | GGG | + | GGAAGGAAGGAAGGGAGGGA | 5634 |
| AGGAAGGAAGGGAGGGAGGG | 2541 | AGG | + | AGGAAGGAAGGGAGGGAGGG | 5635 |
| GGAAGGAAGGGAGGGAGGGA | 2542 | GGG | + | GGAAGGAAGGGAGGGAGGGA | 5636 |
| AGGAAGGGAGGGAGGGAGGG | 2543 | AGG | + | AGGAAGGGAGGGAGGGAGGG | 5637 |
| GGAAGGGAGGGAGGGAGGGA | 2544 | GGG | + | GGAAGGGAGGGAGGGAGGGA | 5638 |
| AGGGAGGGAGGGAGGGAGGG | 2545 | AGG | + | AGGGAGGGAGGGAGGGAGGG | 5639 |
| GGGAGGGAGGGAGGGAGGGA | 2546 | GGG | + | GGGAGGGAGGGAGGGAGGGA | 5640 |
| AGGGAGGGAGGGAGGGAGGG | 2547 | AGG | + | AGGGAGGGAGGGAGGGAGGG | 5641 |
| GGGAGGGAGGGAGGGAGGGA | 2548 | GGG | + | GGGAGGGAGGGAGGGAGGGA | 5642 |
| AGGGAGGGAGGGAGGGAGGG | 2549 | AGG | + | AGGGAGGGAGGGAGGGAGGG | 5643 |
| GGGAGGGAGGGAGGGAGGGA | 2550 | GGG | + | GGGAGGGAGGGAGGGAGGGA | 5644 |
| AGGGAGGGAGGGAGGGAGGG | 2551 | AGG | + | AGGGAGGGAGGGAGGGAGGG | 5645 |
| GGGAGGGAGGGAGGGAGGGA | 2552 | GGG | + | GGGAGGGAGGGAGGGAGGGA | 5646 |
| AGGGAGGGAGGGAGGGAGGG | 2553 | AGG | + | AGGGAGGGAGGGAGGGAGGG | 5647 |
| GGGAGGGAGGGAGGGAGGGA | 2554 | GGG | + | GGGAGGGAGGGAGGGAGGGA | 5648 |
| AGGGAGGGAGGGAGGGAGGG | 2555 | AGG | + | AGGGAGGGAGGGAGGGAGGG | 5649 |
| AGGGAGGGAGGGAGGGAGGA | 2556 | AGG | + | AGGGAGGGAGGGAGGGAGGA | 5650 |
| GATGTTGAGAACAAAAGCCA | 2557 | AGG | + | GAUGUUGAGAACAAAAGCCA | 5651 |
| GAACAAAAGCCAAGGCCAAC | 2558 | AGG | + | GAACAAAAGCCAAGGCCAAC | 5652 |
| GCCAAGGCCAACAGGTGAGT | 2559 | TGG | + | GCCAAGGCCAACAGGUGAGU | 5653 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| CCAAGGCCAACAGGTGAGTT | 2560 | GGG | + | CCAAGGCCAACAGGUGAGUU | 5654 |
| CCCAACTCACCTGTTGGCCT | 2561 | TGG | - | CCCAACUCACCUGUUGGCCU | 5655 |
| CCAACAGGTGAGTTGGGATT | 2562 | AGG | + | CCAACAGGUGAGUUGGGAUU | 5656 |
| CCTAATCCCAACTCACCTGT | 2563 | TGG | - | CCUAAUCCCAACUCACCUGU | 5657 |
| AAAAGTCCTTTTCATAGCAA | 2564 | AGG | + | AAAAGUCCUUUUCAUAGCAA | 5658 |
| AAAGTCCTTTTCATAGCAAA | 2565 | GGG | + | AAAGUCCUUUUCAUAGCAAA | 5659 |
| AAGTCCTTTTCATAGCAAAG | 2566 | GGG | + | AAGUCCUUUUCAUAGCAAAG | 5660 |
| ACATCCCCTTTGCTATGAAA | 2567 | AGG | - | ACAUCCCCUUUGCUAUGAAA | 5661 |
| TTTTCATAGCAAAGGGGATG | 2568 | TGG | + | UUUUCAUAGCAAAGGGGAUG | 5662 |
| GTGGAAGAAGAGAAGTTGAC | 2569 | AGG | + | GUGGAAGAAGAGAAGUUGAC | 5663 |
| AGAGAAGTTGACAGGTAAGT | 2570 | AGG | + | AGAGAAGUUGACAGGUAAGU | 5664 |
| GAGAAGTTGACAGGTAAGTA | 2571 | GGG | + | GAGAAGUUGACAGGUAAGUA | 5665 |
| AGAAAAAGAAAAAAATCTG | 2572 | TGG | + | AGAAAAAGAAAAAAAUCUG | 5666 |
| AAGAAAAAATCTGTGGACC | 2573 | AGG | + | AAGAAAAAAUCUGUGGACC | 5667 |
| AGAAAAAATCTGTGGACCA | 2574 | GGG | + | AGAAAAAAUCUGUGGACCA | 5668 |
| AAAATCTGTGGACCAGGGCA | 2575 | TGG | + | AAAAUCUGUGGACCAGGGCA | 5669 |
| CTGCGTTTCTTGCCATGCCC | 2576 | TGG | - | CUGCGUUUCUUGCCAUGCCC | 5670 |
| GAGCAAATGTTCATAAAGAG | 2577 | AGG | + | GAGCAAAUGUUCAUAAAGAG | 5671 |
| CAAATGTTCATAAAGAGAGG | 2578 | TGG | + | CAAAUGUUCAUAAAGAGAGG | 5672 |
| AAATGTTCATAAAGAGAGGT | 2579 | GGG | + | AAAUGUUCAUAAAGAGAGGU | 5673 |
| GTTCATAAAGAGAGGTGGGC | 2580 | AGG | + | GUUCAUAAAGAGAGGUGGGC | 5674 |
| CATAAAGAGAGGTGGGCAGG | 2581 | AGG | + | CAUAAAGAGAGGUGGGCAGG | 5675 |
| GGTGGGCAGGAGGCAGACCA | 2582 | TGG | + | GGUGGGCAGGAGGCAGACCA | 5676 |
| TCTGATGAGTCTTGAGACCA | 2583 | TGG | - | UCUGAUGAGUCUUGAGACCA | 5677 |
| CAAGACTCATCAGAGAGATA | 2584 | AGG | + | CAAGACUCAUCAGAGAGAUA | 5678 |
| AGAGATAAGGCAATATCCTG | 2585 | AGG | + | AGAGAUAAGGCAAUAUCCUG | 5679 |
| TCCTGAGGAGCACCCATCTG | 2586 | AGG | + | UCCUGAGGAGCACCCAUCUG | 5680 |
| CCTGAGGAGCACCCATCTGA | 2587 | GGG | + | CCUGAGGAGCACCCAUCUGA | 5681 |
| CCCTCAGATGGGTGCTCCTC | 2588 | AGG | - | CCCUCAGAUGGGUGCUCCUC | 5682 |
| CTGAGGAGCACCCATCTGAG | 2589 | GGG | + | CUGAGGAGCACCCAUCUGAG | 5683 |
| TTGCTCAACGCCCCTCAGAT | 2590 | GGG | - | UUGCUCAACGCCCCUCAGAU | 5684 |
| CTTGCTCAACGCCCCTCAGA | 2591 | TGG | - | CUUGCUCAACGCCCCUCAGA | 5685 |
| TCTGAGGGGCGTTGAGCAAG | 2592 | TGG | + | UCUGAGGGGCGUUGAGCAAG | 5686 |
| CTGAGGGGCGTTGAGCAAGT | 2593 | GGG | + | CUGAGGGGCGUUGAGCAAGU | 5687 |
| CATTTCTCTGCATTCACAGA | 2594 | TGG | + | CAUUUCUCUGCAUUCACAGA | 5688 |
| TTCTCTGCATTCACAGATGG | 2595 | AGG | + | UUCUCUGCAUUCACAGAUGG | 5689 |
| TGCAACTATCTTTAGCAGTG | 2596 | AGG | + | UGCAACUAUCUUUAGCAGUG | 5690 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| TCTTTAGCAGTGAGGCATGC | 2597 | TGG | + | UCUUUAGCAGUGAGGCAUGC | 5691 |
| CTTTAGCAGTGAGGCATGCT | 2598 | GGG | + | CUUUAGCAGUGAGGCAUGCU | 5692 |
| ATGCTGGGTAGTGCTAAGAG | 2599 | CGG | + | AUGCUGGGUAGUGCUAAGAG | 5693 |
| TGCTGGGTAGTGCTAAGAGC | 2600 | GGG | + | UGCUGGGUAGUGCUAAGAGC | 5694 |
| TGGGTAGTGCTAAGAGCGGG | 2601 | CGG | + | UGGGUAGUGCUAAGAGCGGG | 5695 |
| GGGTAGTGCTAAGAGCGGGC | 2602 | GGG | + | GGGUAGUGCUAAGAGCGGGC | 5696 |
| GGTAGTGCTAAGAGCGGGCG | 2603 | GGG | + | GGUAGUGCUAAGAGCGGGCG | 5697 |
| CTAAGAGCGGGCGGGGTCTG | 2604 | TGG | + | CUAAGAGCGGGCGGGGUCUG | 5698 |
| AGCGGGCGGGGTCTGTGGAA | 2605 | TGG | + | AGCGGGCGGGGUCUGUGGAA | 5699 |
| GCGGGGTCTGTGGAATGGAG | 2606 | AGG | + | GCGGGGUCUGUGGAAUGGAG | 5700 |
| AATGACGTGGTAATAAGGAG | 2607 | TGG | - | AAUGACGUGGUAAUAAGGAG | 5701 |
| AGTAAAATGACGTGGTAATA | 2608 | AGG | - | AGUAAAAUGACGUGGUAAUA | 5702 |
| TAATCAAAGTAAAATGACG | 2609 | TGG | - | UAAUCAAAGUAAAAUGACG | 5703 |
| CTATGTATCTTGCCTCTTGA | 2610 | CGG | + | CUAUGUAUCUUGCCUCUUGA | 5704 |
| GTACTTGTGTGACCGTCAAG | 2611 | AGG | - | GUACUUGUGUGACCGUCAAG | 5705 |
| AGTACTTCCAGTTGAAGAGT | 2612 | AGG | + | AGUACUUCCAGUUGAAGAGU | 5706 |
| TGTAATGCCTACTCTTCAAC | 2613 | TGG | - | UGUAAUGCCUACUCUUCAAC | 5707 |
| GTTGAAGAGTAGGCATTACA | 2614 | AGG | + | GUUGAAGAGUAGGCAUUACA | 5708 |
| TCTGCTTCCATGAATATTCT | 2615 | AGG | + | UCUGCUUCCAUGAAUAUUCU | 5709 |
| CTGCTTCCATGAATATTCTA | 2616 | GGG | + | CUGCUUCCAUGAAUAUUCUA | 5710 |
| AATGTGCCCTAGAATATTCA | 2617 | TGG | - | AAUGUGCCCUAGAAUAUUCA | 5711 |
| CTAGGGCACATTTTTATTCC | 2618 | AGG | + | CUAGGGCACAUUUUUAUUCC | 5712 |
| TGCTTTCATATATTTTTCC | 2619 | TGG | - | UGCUUUCAUAUAUUUUUCC | 5713 |
| AAAGCATTTCTAATTATGAA | 2620 | TGG | + | AAAGCAUUUCUAAUUAUGAA | 5714 |
| TTTCTAATTATGAATGGAAT | 2621 | TGG | + | UUUCUAAUUAUGAAUGGAAU | 5715 |
| CTAATTATGAATGGAATTGG | 2622 | TGG | + | CUAAUUAUGAAUGGAAUUGG | 5716 |
| TGAATGGAATTGGTGGTTTA | 2623 | TGG | + | UGAAUGGAAUUGGUGGUUUA | 5717 |
| GAATGGAATTGGTGGTTTAT | 2624 | GGG | + | GAAUGGAAUUGGUGGUUUAU | 5718 |
| AATGGAATTGGTGGTTTATG | 2625 | GGG | + | AAUGGAAUUGGUGGUUUAUG | 5719 |
| GGAACACATATGCTCAGCCT | 2626 | TGG | + | GGAACACAUAUGCUCAGCCU | 5720 |
| GGTTTTGGTAATTTATTCCA | 2627 | AGG | - | GGUUUUGGUAAUUUAUUCCA | 5721 |
| ATAAATTACCAAAACCAAAG | 2628 | AGG | + | AUAAAUUACCAAAACCAAAG | 5722 |
| GAGTCTAGCCTCTTTGGTTT | 2629 | TGG | - | GAGUCUAGCCUCUUUGGUUU | 5723 |
| AGAAGGGAGTCTAGCCTCTT | 2630 | TGG | - | AGAAGGGAGUCUAGCCUCUU | 5724 |
| GCTTCTGTTGATCGGTAGAA | 2631 | GGG | - | GCUUCUGUUGAUCGGUAGAA | 5725 |
| TGCTTCTGTTGATCGGTAGA | 2632 | AGG | - | UGCUUCUGUUGAUCGGUAGA | 5726 |
| TCTTATATGCTTCTGTTGAT | 2633 | CGG | - | UCUUAUAUGCUUCUGUUGAU | 5727 |
| CAACAGAAGCATATAAGAGT | 2634 | TGG | + | CAACAGAAGCAUAUAAGAGU | 5728 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| TTCTCTACTCTACCAACTTG | 2635 | TGG | + | UUCUCUACUCUACCAACUUG | 5729 |
| CTACTCTACCAACTTGTGGT | 2636 | TGG | + | CUACUCUACCAACUUGUGGU | 5730 |
| TACTCTACCAACTTGTGGTT | 2637 | GGG | + | UACUCUACCAACUUGUGGUU | 5731 |
| AACAGGACCCAACCACAAGT | 2638 | TGG | - | AACAGGACCCAACCACAAGU | 5732 |
| GTCCTGTTTAGAATAATAAG | 2639 | AGG | + | GUCCUGUUUAGAAUAAUAAG | 5733 |
| TGCCTCTTATTATTCTAAAC | 2640 | AGG | - | UGCCUCUUAUUAUUCUAAAC | 5734 |
| GCATCTACATGTAGAGCTCT | 2641 | AGG | + | GCAUCUACAUGUAGAGCUCU | 5735 |
| TCTAGGAAGCCATTCAATGC | 2642 | AGG | + | UCUAGGAAGCCAUUCAAUGC | 5736 |
| GGTTTAGATCCTGCATTGAA | 2643 | TGG | - | GGUUUAGAUCCUGCAUUGAA | 5737 |
| TCAATGCAGGATCTAAACCT | 2644 | TGG | + | UCAAUGCAGGAUCUAAACCU | 5738 |
| CACAGACATTGCTAAAGCCA | 2645 | AGG | - | CACAGACAUUGCUAAAGCCA | 5739 |
| TGGCTTTAGCAATGTCTGTG | 2646 | CGG | + | UGGCUUUAGCAAUGUCUGUG | 5740 |
| AGCAATGTCTGTGCGGTACT | 2647 | TGG | + | AGCAAUGUCUGUGCGGUACU | 5741 |
| CAAAGAAAACCAAGATTTAT | 2648 | CGG | + | CAAAGAAAACCAAGAUUUAU | 5742 |
| AAAACCAAGATTTATCGGAA | 2649 | TGG | + | AAAACCAAGAUUUAUCGGAA | 5743 |
| ACCAAGATTTATCGGAATGG | 2650 | TGG | + | ACCAAGAUUUAUCGGAAUGG | 5744 |
| TCCACCATTCCGATAAATCT | 2651 | TGG | - | UCCACCAUUCCGAUAAAUCU | 5745 |
| GGTGGACACTGAAAGTAGAC | 2652 | AGG | + | GGUGGACACUGAAAGUAGAC | 5746 |
| ACACTGAAAGTAGACAGGAA | 2653 | AGG | + | ACACUGAAAGUAGACAGGAA | 5747 |
| CCTAGTGTGCAGTGTGCAGA | 2654 | TGG | + | CCUAGUGUGCAGUGUGCAGA | 5748 |
| CCATCTGCACACTGCACACT | 2655 | AGG | - | CCAUCUGCACACUGCACACU | 5749 |
| GTGTGCAGTGTGCAGATGGA | 2656 | AGG | + | GUGUGCAGUGUGCAGAUGGA | 5750 |
| TGTGCAGTGTGCAGATGGAA | 2657 | GGG | + | UGUGCAGUGUGCAGAUGGAA | 5751 |
| TGCAGATGGAAGGGCAGTGC | 2658 | TGG | + | UGCAGAUGGAAGGGCAGUGC | 5752 |
| GCAGATGGAAGGGCAGTGCT | 2659 | GGG | + | GCAGAUGGAAGGGCAGUGCU | 5753 |
| CAGATGGAAGGGCAGTGCTG | 2660 | GGG | + | CAGAUGGAAGGGCAGUGCUG | 5754 |
| TGGGGAGAATCCATTGCATT | 2661 | TGG | + | UGGGGAGAAUCCAUUGCAUU | 5755 |
| CTTCTTCTTTCCAAATGCAA | 2662 | TGG | - | CUUCUUCUUUCCAAAUGCAA | 5756 |
| TTAGCAAAAGAAATCGCAGA | 2663 | GGG | - | UUAGCAAAAGAAAUCGCAGA | 5757 |
| ATTAGCAAAAGAAATCGCAG | 2664 | AGG | - | AUUAGCAAAAGAAAUCGCAG | 5758 |
| GCGATTTCTTTTGCTAATGC | 2665 | AGG | + | GCGAUUUCUUUUGCUAAUGC | 5759 |
| AAGCAAGTACTACAGTGAAA | 2666 | AGG | - | AAGCAAGUACUACAGUGAAA | 5760 |
| TTCACTGTAGTACTTGCTTG | 2667 | TGG | + | UUCACUGUAGUACUUGCUUG | 5761 |
| ACTGTAGTACTTGCTTGTGG | 2668 | TGG | + | ACUGUAGUACUUGCUUGUGG | 5762 |
| TGTGGTGGTTTGAATGAAAA | 2669 | TGG | + | UGUGGUGGUUUGAAUGAAAA | 5763 |
| TGAATGAAAATGGTCCCCAC | 2670 | AGG | + | UGAAUGAAAAUGGUCCCCAC | 5764 |
| GTTTTCAAAAATAGCCTGTG | 2671 | GGG | - | GUUUUCAAAAAUAGCCUGUG | 5765 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| AGTTTTCAAAAATAGCCTGT | 2672 | GGG | - | AGUUUUCAAAAAUAGCCUGU | 5766 |
| AAGTTTTCAAAAATAGCCTG | 2673 | TGG | - | AAGUUUUCAAAAAUAGCCUG | 5767 |
| TTGAAAACTTGATCCCCAGT | 2674 | TGG | + | UUGAAAACUUGAUCCCCAGU | 5768 |
| CCCCAGTTGGTGAAACTGTT | 2675 | TGG | + | CCCCAGUUGGUGAAACUGUU | 5769 |
| CCAAACAGTTTCACCAACTG | 2676 | GGG | - | CCAAACAGUUUCACCAACUG | 5770 |
| TCCAAACAGTTTCACCAACT | 2677 | GGG | - | UCCAAACAGUUUCACCAACU | 5771 |
| TTCCAAACAGTTTCACCAAC | 2678 | TGG | - | UUCCAAACAGUUUCACCAAC | 5772 |
| GTTGGTGAAACTGTTTGGAA | 2679 | AGG | + | GUUGGUGAAACUGUUUGGAA | 5773 |
| GAAACTGTTTGGAAGGATT | 2680 | AGG | + | GAAACUGUUUGGAAGGAUU | 5774 |
| TTGGAAGGATTAGGAAGTG | 2681 | TGG | + | UUGGAAGGAUUAGGAAGUG | 5775 |
| ATTAGGAAGTGTGGCCTTGC | 2682 | TGG | + | AUUAGGAAGUGUGGCCUUGC | 5776 |
| AAGTGTGGCCTTGCTGGATG | 2683 | AGG | + | AAGUGUGGCCUUGCUGGAUG | 5777 |
| TTGACAGACCTCATCCAGCA | 2684 | AGG | - | UUGACAGACCUCAUCCAGCA | 5778 |
| TGCTGGATGAGGTCTGTCAA | 2685 | TGG | + | UGCUGGAUGAGGUCUGUCAA | 5779 |
| TGGATGAGGTCTGTCAATGG | 2686 | CGG | + | UGGAUGAGGUCUGUCAAUGG | 5780 |
| TGAGGTCTGTCAATGGCGGA | 2687 | AGG | + | UGAGGUCUGUCAAUGGCGGA | 5781 |
| GAGACAGAGAGAGGCACACT | 2688 | GGG | - | GAGACAGAGAGAGGCACACU | 5782 |
| GGAGACAGAGAGAGGCACAC | 2689 | TGG | - | GGAGACAGAGAGAGGCACAC | 5783 |
| AATAAGTAGGAGACAGAGAG | 2690 | AGG | - | AAUAAGUAGGAGACAGAGAG | 5784 |
| TCATTTTTCAATCAATAAGT | 2691 | AGG | - | UCAUUUUUCAAUCAAUAAGU | 5785 |
| AATTCTGGATGGCAGAGCAA | 2692 | AGG | - | AAUUCUGGAUGGCAGAGCAA | 5786 |
| TGGGTGATTAGAATTCTGGA | 2693 | TGG | - | UGGGUGAUUAGAAUUCUGGA | 5787 |
| GTTTTGGGTGATTAGAATTC | 2694 | TGG | - | GUUUUGGGUGAUUAGAAUUC | 5788 |
| TAATTAGGCTATATGGTTTT | 2695 | GGG | - | UAAUUAGGCUAUAUGGUUUU | 5789 |
| TTAATTAGGCTATATGGTTT | 2696 | TGG | - | UUAAUUAGGCUAUAUGGUUU | 5790 |
| CAGTATTTAATTAGGCTATA | 2697 | TGG | - | CAGUAUUUAAUUAGGCUAUA | 5791 |
| TATAAAACAGTATTTAATT | 2698 | AGG | - | UAUAAAACAGUAUUUAAUU | 5792 |
| ACTGTTTTATAAGTTACCT | 2699 | TGG | + | ACUGUUUUUAUAAGUUACCU | 5793 |
| TTTATAAGTTACCTTGGTCA | 2700 | TGG | + | UUUAUAAGUUACCUUGGUCA | 5794 |
| TACCTTGGTCATGGTACTTT | 2701 | AGG | + | UACCUUGGUCAUGGUACUUU | 5795 |
| ATCCTAAAGTACCATGACCA | 2702 | AGG | - | AUCCUAAAGUACCAUGACCA | 5796 |
| TAGTTAAGAAACTAAGACAT | 2703 | TGG | + | UAGUUAAGAAACUAAGACAU | 5797 |
| CTTAACCAAAACACCACAGA | 2704 | CGG | + | CUUAACCAAAACACCACAGA | 5798 |
| TTAACCAAAACACCACAGAC | 2705 | GGG | + | UUAACCAAAACACCACAGAC | 5799 |
| CAAGCCCGTCTGTGGTGTTT | 2706 | TGG | - | CAAGCCCGUCUGUGGUGUUU | 5800 |
| GTCATATGCAAGCCCGTCTG | 2707 | TGG | - | GUCAUAUGCAAGCCCGUCUG | 5801 |
| GCATATGACAACAGTTCTAG | 2708 | AGG | + | GCAUAUGACAACAGUUCUAG | 5802 |
| CCCTGATCAAATGCCCTAGC | 2709 | AGG | + | CCCUGAUCAAAUGCCCUAGC | 5803 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| CCTGCTAGGGCATTTGATCA | 2710 | GGG | - | CCUGCUAGGGCAUUUGAUCA | 5804 |
| ACCTGCTAGGGCATTTGATC | 2711 | AGG | - | ACCUGCUAGGGCAUUUGAUC | 5805 |
| ATCAGACACAGAACCTGCTA | 2712 | GGG | - | AUCAGACACAGAACCUGCUA | 5806 |
| CATCAGACACAGAACCTGCT | 2713 | AGG | - | CAUCAGACACAGAACCUGCU | 5807 |
| AGCAGGTTCTGTGTCTGATG | 2714 | AGG | + | AGCAGGUUCUGUGUCUGAUG | 5808 |
| GCAGGTTCTGTGTCTGATGA | 2715 | GGG | + | GCAGGUUCUGUGUCUGAUGA | 5809 |
| CTGTGTCTGATGAGGGCTGC | 2716 | TGG | + | CUGUGUCUGAUGAGGGCUGC | 5810 |
| TGATGAGGGCTGCTGGTTCA | 2717 | TGG | + | UGAUGAGGGCUGCUGGUUCA | 5811 |
| GATGAGGGCTGCTGGTTCAT | 2718 | GGG | + | GAUGAGGGCUGCUGGUUCAU | 5812 |
| GAGGGCTGCTGGTTCATGGG | 2719 | TGG | + | GAGGGCUGCUGGUUCAUGGG | 5813 |
| CTTTTTCTCAGTGTCCTTAC | 2720 | AGG | + | CUUUUUCUCAGUGUCCUUAC | 5814 |
| TTTCTCAGTGTCCTTACAGG | 2721 | TGG | + | UUUCUCAGUGUCCUUACAGG | 5815 |
| TCAGTGTCCTTACAGGTGGA | 2722 | AGG | + | UCAGUGUCCUUACAGGUGGA | 5816 |
| CTGGATACCTTCCACCTGTA | 2723 | AGG | - | CUGGAUACCUUCCACCUGUA | 5817 |
| TGGAAGGTATCCAGCTTTCT | 2724 | TGG | + | UGGAAGGUAUCCAGCUUUCU | 5818 |
| AATATAAGGTCCAAGAAAGC | 2725 | TGG | - | AAUAUAAGGUCCAAGAAAGC | 5819 |
| GGAATGCGTGCTTTAATATA | 2726 | AGG | - | GGAAUGCGUGCUUUAAUAUA | 5820 |
| AAGCTATCTACTCACATCAA | 2727 | TGG | - | AAGCUAUCUACUCACAUCAA | 5821 |
| GAGGTGCTTAAATCACTTTG | 2728 | GGG | - | GAGGUGCUUAAAUCACUUUG | 5822 |
| GGAGGTGCTTAAATCACTTT | 2729 | GGG | - | GGAGGUGCUUAAAUCACUUU | 5823 |
| TGGAGGTGCTTAAATCACTT | 2730 | TGG | - | UGGAGGUGCUUAAAUCACUU | 5824 |
| CCTCCAAAACCCTCCGTCTC | 2731 | CGG | + | CCUCCAAAACCCUCCGUCUC | 5825 |
| CCGGAGACGGAGGGTTTTGG | 2732 | AGG | - | CCGGAGACGGAGGGUUUUGG | 5826 |
| CATCCGGAGACGGAGGGTTT | 2733 | TGG | - | CAUCCGGAGACGGAGGGUUU | 5827 |
| GGGGAGCATCCGGAGACGGA | 2734 | GGG | - | GGGGAGCAUCCGGAGACGGA | 5828 |
| GGGGGAGCATCCGGAGACGG | 2735 | AGG | - | GGGGGAGCAUCCGGAGACGG | 5829 |
| AATGGGGAGCATCCGGAGA | 2736 | CGG | - | AAUGGGGAGCAUCCGGAGA | 5830 |
| GTCTCCGGATGCTCCCCAT | 2737 | TGG | + | GUCUCCGGAUGCUCCCCAU | 5831 |
| TTCACCAATGGGGAGCATC | 2738 | CGG | - | UUCACCAAUGGGGAGCAUC | 5832 |
| TGAAATCTGTTCACCAATGG | 2739 | GGG | - | UGAAAUCUGUUCACCAAUGG | 5833 |
| TTGAAATCTGTTCACCAATG | 2740 | GGG | - | UUGAAAUCUGUUCACCAAUG | 5834 |
| GTTGAAATCTGTTCACCAAT | 2741 | GGG | - | GUUGAAAUCUGUUCACCAAU | 5835 |
| TGTTGAAATCTGTTCACCAA | 2742 | TGG | - | UGUUGAAAUCUGUUCACCAA | 5836 |
| TTTCAACATAGCAATTGAGC | 2743 | AGG | + | UUUCAACAUAGCAAUUGAGC | 5837 |
| CAACATAGCAATTGAGCAGG | 2744 | AGG | + | CAACAUAGCAAUUGAGCAGG | 5838 |
| TAGCAATTGAGCAGGAGGAA | 2745 | AGG | + | UAGCAAUUGAGCAGGAGGAA | 5839 |
| CTGGCTGTGATCAAATAATT | 2746 | TGG | - | CUGGCUGUGAUCAAAUAAUU | 5840 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| TTTGATCACAGCCAGTACTT | 2747 | TGG | + | UUUGAUCACAGCCAGUACUU | 5841 |
| TTGGGTGTTCACCAAAGTAC | 2748 | TGG | - | UUGGGUGUUCACCAAAGUAC | 5842 |
| GTGAACACCCAAACCCAGCA | 2749 | TGG | + | GUGAACACCCAAACCCAGCA | 5843 |
| TTCAGCTCCATGCTGGGTTT | 2750 | GGG | - | UUCAGCUCCAUGCUGGGUUU | 5844 |
| ATTCAGCTCCATGCTGGGTT | 2751 | TGG | - | AUUCAGCUCCAUGCUGGGUU | 5845 |
| CAGATATTCAGCTCCATGCT | 2752 | GGG | - | CAGAUAUUCAGCUCCAUGCU | 5846 |
| ACAGATATTCAGCTCCATGC | 2753 | TGG | - | ACAGAUAUUCAGCUCCAUGC | 5847 |
| CTGTAATCTCAGTATCCAGC | 2754 | AGG | + | CUGUAAUCUCAGUAUCCAGC | 5848 |
| TAATCTCAGTATCCAGCAGG | 2755 | TGG | + | UAAUCUCAGUAUCCAGCAGG | 5849 |
| AGTATCCAGCAGGTGGATAT | 2756 | TGG | + | AGUAUCCAGCAGGUGGAUAU | 5850 |
| GTATCCAGCAGGTGGATATT | 2757 | GGG | + | GUAUCCAGCAGGUGGAUAUU | 5851 |
| TATCCAGCAGGTGGATATTG | 2758 | GGG | + | UAUCCAGCAGGUGGAUAUUG | 5852 |
| ATTCCCCAATATCCACCTGC | 2759 | TGG | - | AUUCCCCAAUAUCCACCUGC | 5853 |
| ATTGGGGAATTAAGACTTCA | 2760 | AGG | + | AUUGGGGAAUUAAGACUUCA | 5854 |
| TAAGACTTCAAGGCCAGACT | 2761 | TGG | + | UAAGACUUCAAGGCCAGACU | 5855 |
| ACTTACTATGTAGCCAAGTC | 2762 | TGG | - | ACUUACUAUGUAGCCAAGUC | 5856 |
| TAGTAAGTTTGATGCCATCC | 2763 | TGG | + | UAGUAAGUUUGAUGCCAUCC | 5857 |
| AGTAAGTTTGATGCCATCCT | 2764 | GGG | + | AGUAAGUUUGAUGCCAUCCU | 5858 |
| GGATCTCATATAGCCCAGGA | 2765 | TGG | - | GGAUCUCAUAUAGCCCAGGA | 5859 |
| AACAGGATCTCATATAGCCC | 2766 | AGG | - | AACAGGAUCUCAUAUAGCCC | 5860 |
| TATTTGGGGTTTTGGAAAC | 2767 | AGG | - | UAUUUGGGGGUUUUGGAAAC | 5861 |
| TTGTTTCTATTTGGGGGTTT | 2768 | TGG | - | UUGUUUCUAUUUGGGGGUUU | 5862 |
| TTTTTATTGTTTCTATTTGG | 2769 | GGG | - | UUUUUAUUGUUUCUAUUUGG | 5863 |
| TTTTTTATTGTTTCTATTTG | 2770 | GGG | - | UUUUUUAUUGUUUCUAUUUG | 5864 |
| TTTTTTTATTGTTTCTATTT | 2771 | GGG | - | UUUUUUUAUUGUUUCUAUUU | 5865 |
| ATTTTTTTATTGTTTCTATT | 2772 | TGG | - | AUUUUUUUAUUGUUUCUAUU | 5866 |
| AAATAGAAACAATAAAAAAA | 2773 | TGG | + | AAAUAGAAACAAUAAAAAAA | 5867 |
| TAGGGTAGCAGTGAACATGA | 2774 | AGG | - | UAGGGUAGCAGUGAACAUGA | 5868 |
| ATGTTCACTGCTACCCTAGA | 2775 | AGG | + | AUGUUCACUGCUACCCUAGA | 5869 |
| CAAGCAAAACTGACCTTCTA | 2776 | GGG | - | CAAGCAAAACUGACCUUCUA | 5870 |
| ACAAGCAAAACTGACCTTCT | 2777 | AGG | - | ACAAGCAAAACUGACCUUCU | 5871 |
| TTGTAACAGATGACTAACAG | 2778 | AGG | + | UUGUAACAGAUGACUAACAG | 5872 |
| AGATGACTAACAGAGGAACA | 2779 | AGG | + | AGAUGACUAACAGAGGAACA | 5873 |
| CTAACAGAGGAACAAGGTCC | 2780 | CGG | + | CUAACAGAGGAACAAGGUCC | 5874 |
| AGCATACTGGTAGCTCTTCC | 2781 | GGG | - | AGCAUACUGGUAGCUCUUCC | 5875 |
| CAGCATACTGGTAGCTCTTC | 2782 | CGG | - | CAGCAUACUGGUAGCUCUUC | 5876 |
| CGGAAGAGCTACCAGTATGC | 2783 | TGG | + | CGGAAGAGCUACCAGUAUGC | 5877 |
| TTCATTGGCAGCCAGCATAC | 2784 | TGG | - | UUCAUUGGCAGCCAGCAUAC | 5878 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| TAAGACTTCAGCAGCTTCAT | 2785 | TGG | - | UAAGACUUCAGCAGCUUCAU | 5879 |
| GCTGAAGTCTTAGTAGATTT | 2786 | AGG | + | GCUGAAGUCUUAGUAGAUUU | 5880 |
| CTTAGTAGATTTAGGAGCTA | 2787 | TGG | + | CUUAGUAGAUUUAGGAGCUA | 5881 |
| CTGGGGCTGTGATGGAAGTC | 2788 | AGG | - | CUGGGGCUGUGAUGGAAGUC | 5882 |
| TGGTGGTGCTGGGGCTGTGA | 2789 | TGG | - | UGGUGGUGCUGGGGCUGUGA | 5883 |
| TCACAGCCCCAGCACCACCA | 2790 | TGG | + | UCACAGCCCCAGCACCACCA | 5884 |
| CACAGCCCCAGCACCACCAT | 2791 | GGG | + | CACAGCCCCAGCACCACCAU | 5885 |
| CAGTGCCCATGGTGGTGCTG | 2792 | GGG | - | CAGUGCCCAUGGUGGUGCUG | 5886 |
| GCAGTGCCCATGGTGGTGCT | 2793 | GGG | - | GCAGUGCCCAUGGUGGUGCU | 5887 |
| GGCAGTGCCCATGGTGGTGC | 2794 | TGG | - | GGCAGUGCCCAUGGUGGUGC | 5888 |
| CTGCTGGGCAGTGCCCATGG | 2795 | TGG | - | CUGCUGGGCAGUGCCCAUGG | 5889 |
| AGACTGCTGGGCAGTGCCCA | 2796 | TGG | - | AGACUGCUGGGCAGUGCCCA | 5890 |
| CTAAAAGAAGATAGACTGCT | 2797 | GGG | - | CUAAAAGAAGAUAGACUGCU | 5891 |
| CCAGCAGTCTATCTTCTTTT | 2798 | AGG | + | CCAGCAGUCUAUCUUCUUUU | 5892 |
| CCTAAAAGAAGATAGACTGC | 2799 | TGG | - | CCUAAAAGAAGAUAGACUGC | 5893 |
| CTATCTTCTTTTAGGTCTTC | 2800 | AGG | + | CUAUCUUCUUUUAGGUCUUC | 5894 |
| TTTAGGTCTTCAGGTGTCCC | 2801 | TGG | + | UUUAGGUCUUCAGGUGUCCC | 5895 |
| TTAGGTCTTCAGGTGTCCCT | 2802 | GGG | + | UUAGGUCUUCAGGUGUCCCU | 5896 |
| GTGTCCCTGGGTAGAGAACA | 2803 | AGG | + | GUGUCCCUGGGUAGAGAACA | 5897 |
| GAAGCCTTGTTCTCTACCCA | 2804 | GGG | - | GAAGCCUUGUUCUCUACCCA | 5898 |
| AGAAGCCTTGTTCTCTACCC | 2805 | AGG | - | AGAAGCCUUGUUCUCUACCC | 5899 |
| AACAAGGCTTCTGCTTGCAT | 2806 | AGG | + | AACAAGGCUUCUGCUUGCAU | 5900 |
| ACAAGGCTTCTGCTTGCATA | 2807 | GGG | + | ACAAGGCUUCUGCUUGCAUA | 5901 |
| GTGAGACTGTCACTGTACTG | 2808 | GGG | - | GUGAGACUGUCACUGUACUG | 5902 |
| TGTGAGACTGTCACTGTACT | 2809 | GGG | - | UGUGAGACUGUCACUGUACU | 5903 |
| TTGTGAGACTGTCACTGTAC | 2810 | TGG | - | UUGUGAGACUGUCACUGUAC | 5904 |
| TCACAATGAGTGCAGCAATG | 2811 | TGG | + | UCACAAUGAGUGCAGCAAUG | 5905 |
| GCAGCAATGTGGCCACAGAA | 2812 | CGG | + | GCAGCAAUGUGGCCACAGAA | 5906 |
| CAGCAATGTGGCCACAGAAC | 2813 | GGG | + | CAGCAAUGUGGCCACAGAAC | 5907 |
| AGCAATGTGGCCACAGAACG | 2814 | GGG | + | AGCAAUGUGGCCACAGAACG | 5908 |
| ACACACATTTCCCCGTTCTG | 2815 | TGG | - | ACACACAUUUCCCCGUUCUG | 5909 |
| TCAAGCTGAAAGCTTTTCAC | 2816 | AGG | + | UCAAGCUGAAAGCUUUUCAC | 5910 |
| TCTCTTGCTAAATGACAAAG | 2817 | TGG | + | UCUCUUGCUAAAUGACAAAG | 5911 |
| CTAAATGACAAAGTGGTTAG | 2818 | AGG | + | CUAAAUGACAAAGUGGUUAG | 5912 |
| AATGACAAAGTGGTTAGAGG | 2819 | AGG | + | AAUGACAAAGUGGUUAGAGG | 5913 |
| ATGACAAAGTGGTTAGAGGA | 2820 | GGG | + | AUGACAAAGUGGUUAGAGGA | 5914 |
| GTGTAGACAATGAAAGCTGT | 2821 | AGG | - | GUGUAGACAAUGAAAGCUGU | 5915 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| AGCTTTCATTGTCTACACTC | 2822 | AGG | + | AGCUUUCAUUGUCUACACUC | 5916 |
| TCTTTTGAGAATTTTACAGT | 2823 | AGG | + | UCUUUUGAGAAUUUUACAGU | 5917 |
| CTAGTCAACACAGAAATAAA | 2824 | AGG | + | CUAGUCAACACAGAAAUAAA | 5918 |
| TTTGTTTTGTTGAAAAGAAG | 2825 | TGG | + | UUUGUUUUGUUGAAAAGAAG | 5919 |
| TTGTTTTGTTGAAAAGAAGT | 2826 | GGG | + | UUGUUUUGUUGAAAAGAAGU | 5920 |
| TGTTTTGTTGAAAAGAAGTG | 2827 | GGG | + | UGUUUUGUUGAAAAGAAGUG | 5921 |
| GTTTTGTTGAAAAGAAGTGG | 2828 | GGG | + | GUUUUGUUGAAAAGAAGUGG | 5922 |
| TTGAAAAGAAGTGGGGTTT | 2829 | TGG | + | UUGAAAAGAAGUGGGGUUU | 5923 |
| TGGGGGTTTTGGTACTGATG | 2830 | AGG | + | UGGGGGUUUUGGUACUGAUG | 5924 |
| GGGGGTTTTGGTACTGATGA | 2831 | GGG | + | GGGGGUUUUGGUACUGAUGA | 5925 |
| GGGGTTTTGGTACTGATGAG | 2832 | GGG | + | GGGGUUUUGGUACUGAUGAG | 5926 |
| TATGTTACTTATTCATTCTC | 2833 | AGG | + | UAUGUUACUUAUUCAUUCUC | 5927 |
| CTTATTCATTCTCAGGTTCA | 2834 | TGG | + | CUUAUUCAUUCUCAGGUUCA | 5928 |
| TTAATCTATCATTTGTCATA | 2835 | AGG | - | UUAAUCUAUCAUUUGUCAUA | 5929 |
| TAATAAAGCATGCAAATGC | 2836 | TGG | + | UAAUAAAGCAUGCAAAUGC | 5930 |
| TGCAAATGCTGGAGCTCTGC | 2837 | TGG | + | UGCAAAUGCUGGAGCUCUGC | 5931 |
| AAATGCTGGAGCTCTGCTGG | 2838 | CGG | + | AAAUGCUGGAGCUCUGCUGG | 5932 |
| GGCGGAGTACCTGATATGCA | 2839 | AGG | + | GGCGGAGUACCUGAUAUGCA | 5933 |
| GATCTTCATCCTTGCATATC | 2840 | AGG | - | GAUCUUCAUCCUUGCAUAUC | 5934 |
| GCTTTTTATTTGATTTCTG | 2841 | GGG | - | GCUUUUUAUUUGAUUUCUG | 5935 |
| AGCTTTTTTATTTGATTTCT | 2842 | GGG | - | AGCUUUUUUAUUUGAUUUCU | 5936 |
| CAGCTTTTTTATTTGATTTC | 2843 | TGG | - | CAGCUUUUUUAUUUGAUUUC | 5937 |
| CAGAAATCAAATAAAAAAGC | 2844 | TGG | + | CAGAAAUCAAAUAAAAAAGC | 5938 |
| AGAAATCAAATAAAAAGCT | 2845 | GGG | + | AGAAAUCAAAUAAAAAGCU | 5939 |
| TAAAAAGCTGGGCATAGTG | 2846 | AGG | + | UAAAAAGCUGGGCAUAGUG | 5940 |
| AGCTGGGCATAGTGAGGAAG | 2847 | AGG | + | AGCUGGGCAUAGUGAGGAAG | 5941 |
| GCATAGTGAGGAAGAGGAGA | 2848 | TGG | + | GCAUAGUGAGGAAGAGGAGA | 5942 |
| CATAGTGAGGAAGAGGAGAT | 2849 | GGG | + | CAUAGUGAGGAAGAGGAGAU | 5943 |
| AGTGAGGAAGAGGAGATGGG | 2850 | AGG | + | AGUGAGGAAGAGGAGAUGGG | 5944 |
| AGGAGATGGGAGGATTCCTG | 2851 | TGG | + | AGGAGAUGGGAGGAUUCCUG | 5945 |
| GATGGGAGGATTCCTGTGGC | 2852 | TGG | + | GAUGGGAGGAUUCCUGUGGC | 5946 |
| GGAGGATTCCTGTGGCTGGC | 2853 | TGG | + | GGAGGAUUCCUGUGGCUGGC | 5947 |
| TTAGCTGTCCAGCCAGCCAC | 2854 | AGG | - | UUAGCUGUCCAGCCAGCCAC | 5948 |
| TGGAAATAGATGAATAGGCT | 2855 | AGG | - | UGGAAAUAGAUGAAUAGGCU | 5949 |
| TAGCCTATTCATCTATTTCC | 2856 | AGG | + | UAGCCUAUUCAUCUAUUUCC | 5950 |
| TGGCCTGGAAATAGATGAAT | 2857 | AGG | - | UGGCCUGGAAAUAGAUGAAU | 5951 |
| CATCTATTTCCAGGCCACTA | 2858 | AGG | + | CAUCUAUUUCCAGGCCACUA | 5952 |
| ATCTATTTCCAGGCCACTAA | 2859 | GGG | + | AUCUAUUUCCAGGCCACUAA | 5953 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| ATTTCCAGGCCACTAAGGGA | 2860 | TGG | + | AUUUCCAGGCCACUAAGGGA | 5954 |
| GGTACCATCCCTTAGTGGCC | 2861 | TGG | - | GGUACCAUCCCUUAGUGGCC | 5955 |
| TTTAAGGTACCATCCCTTAG | 2862 | TGG | - | UUUAAGGUACCAUCCCUUAG | 5956 |
| ATTATTATTGTTATTTTTA | 2863 | AGG | - | AUUAUUAUUGUUAUUUUUA | 5957 |
| ACAATAATAATAAATAAAAA | 2864 | AGG | + | ACAAUAAUAAUAAAUAAAAA | 5958 |
| TAATAAATAAAAAAGGTAGC | 2865 | TGG | + | UAAUAAAUAAAAAAGGUAGC | 5959 |
| AAAAAGGTAGCTGGTTCCTG | 2866 | AGG | + | AAAAAGGUAGCUGGUUCCUG | 5960 |
| TGGTTCCTGAGGAGCATCTA | 2867 | AGG | + | UGGUUCCUGAGGAGCAUCUA | 5961 |
| GATATCCTTAGATGCTCCTC | 2868 | AGG | - | GAUAUCCUUAGAUGCUCCUC | 5962 |
| GTATGTGCACGTGGAGTTAA | 2869 | AGG | - | GUAUGUGCACGUGGAGUUAA | 5963 |
| GTATACAGTGTATGTGCACG | 2870 | TGG | - | GUAUACAGUGUAUGUGCACG | 5964 |
| TGCACATACACTGTATACAC | 2871 | AGG | + | UGCACAUACACUGUAUACAC | 5965 |
| TTTTTTTGGTAAAACTTGAT | 2872 | AGG | - | UUUUUUUGGUAAAACUUGAU | 5966 |
| TTTTTTTTTTTTTTTTTTT | 2873 | TGG | - | UUUUUUUUUUUUUUUUUUU | 5967 |
| AAGAACACTTTATTCACTGT | 2874 | TGG | + | AAGAACACUUUAUUCACUGU | 5968 |
| AACACTTTATTCACTGTTGG | 2875 | TGG | + | AACACUUUAUUCACUGUUGG | 5969 |
| ACACTTTATTCACTGTTGGT | 2876 | GGG | + | ACACUUUAUUCACUGUUGGU | 5970 |
| CTGTTGGTGGGTATGTAAAC | 2877 | TGG | + | CUGUUGGUGGGUAUGUAAAC | 5971 |
| CTCTGTGCTGATTTTCATAG | 2878 | TGG | - | CUCUGUGCUGAUUUUCAUAG | 5972 |
| CACTATGAAAATCAGCACAG | 2879 | AGG | + | CACUAUGAAAAUCAGCACAG | 5973 |
| TTGTTTTGTTGGAGTGGGAA | 2880 | GGG | - | UUGUUUUGUUGGAGUGGGAA | 5974 |
| TTTGTTTTGTTGGAGTGGGA | 2881 | AGG | - | UUUGUUUUGUUGGAGUGGGA | 5975 |
| TTGTTTTGTTTTGTTGGAGT | 2882 | GGG | - | UUGUUUUGUUUUGUUGGAGU | 5976 |
| TTTGTTTTGTTTTGTTGGAG | 2883 | TGG | - | UUUGUUUUGUUUUGUUGGAG | 5977 |
| TTTGTTTTGTTTTGTTTTGT | 2884 | TGG | - | UUUGUUUUGUUUUGUUUUGU | 5978 |
| GTTCTAGTTCTAGTTCTAGA | 2885 | GGG | - | GUUCUAGUUCUAGUUCUAGA | 5979 |
| AGTTCTAGTTCTAGTTCTAG | 2886 | AGG | - | AGUUCUAGUUCUAGUUCUAG | 5980 |
| CTAGAACTACTGCACGATCC | 2887 | AGG | + | CUAGAACUACUGCACGAUCC | 5981 |
| GATCCAGGTTTACCACTCCT | 2888 | AGG | + | GAUCCAGGUUUACCACUCCU | 5982 |
| ATACCTAGGAGTGGTAAACC | 2889 | TGG | - | AUACCUAGGAGUGGUAAACC | 5983 |
| TTTGAGTAAATACCTAGGAG | 2890 | TGG | - | UUUGAGUAAAUACCUAGGAG | 5984 |
| ACTCCTAGGTATTTACTCAA | 2891 | AGG | + | ACUCCUAGGUAUUUACUCAA | 5985 |
| AGTCCTTTGAGTAAATACCT | 2892 | AGG | - | AGUCCUUUGAGUAAAUACCU | 5986 |
| TATACGTCAACCTGTGACAG | 2893 | AGG | + | UAUACGUCAACCUGUGACAG | 5987 |
| GTATATGATGCCTCTGTCAC | 2894 | AGG | - | GUAUAUGAUGCCUCUGUCAC | 5988 |
| CAGAGGCATCATATACAAGC | 2895 | AGG | + | CAGAGGCAUCAUAUACAAGC | 5989 |
| AGAGGCATCATATACAAGCA | 2896 | GGG | + | AGAGGCAUCAUAUACAAGCA | 5990 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| CATCATATACAAGCAGGGAG | 2897 | TGG | + | CAUCAUAUACAAGCAGGGAG | 5991 |
| CATATACAAGCAGGGAGTGG | 2898 | TGG | + | CAUAUACAAGCAGGGAGUGG | 5992 |
| TGAGGGGTGGGATTAAAGGC | 2899 | AGG | - | UGAGGGGUGGGAUUAAAGGC | 5993 |
| TGCCTTTAATCCCACCCCTC | 2900 | AGG | + | UGCCUUUAAUCCCACCCCUC | 5994 |
| CTCCTGAGGGGTGGGATTAA | 2901 | AGG | - | CUCCUGAGGGGUGGGAUUAA | 5995 |
| CTTTAATCCCACCCCTCAGG | 2902 | AGG | + | CUUUAAUCCCACCCCUCAGG | 5996 |
| GACTCTGCCTCCTGAGGGGT | 2903 | GGG | - | GACUCUGCCUCCUGAGGGGU | 5997 |
| TGACTCTGCCTCCTGAGGGG | 2904 | TGG | - | UGACUCUGCCUCCUGAGGGG | 5998 |
| ACCCCTCAGGAGGCAGAGTC | 2905 | AGG | + | ACCCCUCAGGAGGCAGAGUC | 5999 |
| ACCTGACTCTGCCTCCTGAG | 2906 | GGG | - | ACCUGACUCUGCCUCCUGAG | 6000 |
| TACCTGACTCTGCCTCCTGA | 2907 | GGG | - | UACCUGACUCUGCCUCCUGA | 6001 |
| CTACCTGACTCTGCCTCCTG | 2908 | AGG | - | CUACCUGACUCUGCCUCCUG | 6002 |
| GGTAGATCTCTGTGAGTTCG | 2909 | AGG | + | GGUAGAUCUCUGUGAGUUCG | 6003 |
| CTGTGAGTTCGAGGCCAGTT | 2910 | TGG | + | CUGUGAGUUCGAGGCCAGUU | 6004 |
| ACTCACTATGTAGACCAAAC | 2911 | TGG | - | ACUCACUAUGUAGACCAAAC | 6005 |
| CATATGGCTATATGGTCTTA | 2912 | TGG | - | CAUAUGGCUAUAUGGUCUUA | 6006 |
| CATAAGACCATATAGCCATA | 2913 | TGG | + | CAUAAGACCAUAUAGCCAUA | 6007 |
| AAGACCATATAGCCATATGG | 2914 | AGG | + | AAGACCAUAUAGCCAUAUGG | 6008 |
| AGACCATATAGCCATATGGA | 2915 | GGG | + | AGACCAUAUAGCCAUAUGGA | 6009 |
| GACCATATAGCCATATGGAG | 2916 | GGG | + | GACCAUAUAGCCAUAUGGAG | 6010 |
| ACCATATAGCCATATGGAGG | 2917 | GGG | + | ACCAUAUAGCCAUAUGGAGG | 6011 |
| CCATATAGCCATATGGAGGG | 2918 | GGG | + | CCAUAUAGCCAUAUGGAGGG | 6012 |
| CCCCCCTCCATATGGCTATA | 2919 | TGG | - | CCCCCCUCCAUAUGGCUAUA | 6013 |
| CTCACAATCCCCCCTCCATA | 2920 | TGG | - | CUCACAAUCCCCCCUCCAUA | 6014 |
| GAGAGAATTATTAAATGAAT | 2921 | TGG | + | GAGAGAAUUAUUAAAUGAAU | 6015 |
| TATACACTGTCTTCTTTCAT | 2922 | AGG | + | UAUACACUGUCUUCUUUCAU | 6016 |
| CATAGGAAAAATGAACAGAA | 2923 | AGG | + | CAUAGGAAAAAUGAACAGAA | 6017 |
| ATAGGAAAAATGAACAGAAA | 2924 | GGG | + | AUAGGAAAAAUGAACAGAAA | 6018 |
| AACAGAAGGGAGAGATCTT | 2925 | TGG | + | AACAGAAGGGAGAGAUCUU | 6019 |
| ACAGAAGGGAGAGATCTTT | 2926 | GGG | + | ACAGAAGGGAGAGAUCUUU | 6020 |
| GAAAGGGAGAGATCTTTGGG | 2927 | TGG | + | GAAAGGGAGAGAUCUUUGGG | 6021 |
| AAAGGGAGAGATCTTTGGGT | 2928 | GGG | + | AAAGGGAGAGAUCUUUGGGU | 6022 |
| AAGGGAGAGATCTTTGGGTG | 2929 | GGG | + | AAGGGAGAGAUCUUUGGGUG | 6023 |
| ATACATGACATGAAAGCAGA | 2930 | AGG | + | AUACAUGACAUGAAAGCAGA | 6024 |
| TACATGACATGAAAGCAGAA | 2931 | GGG | + | UACAUGACAUGAAAGCAGAA | 6025 |
| ACATGACATGAAAGCAGAAG | 2932 | GGG | + | ACAUGACAUGAAAGCAGAAG | 6026 |
| AGCAGAAGGGGATTAGTTAT | 2933 | TGG | + | AGCAGAAGGGGAUUAGUUAU | 6027 |
| GAAGGGGATTAGTTATTGGA | 2934 | AGG | + | GAAGGGGAUUAGUUAUUGGA | 6028 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| GGGATTAGTTATTGGAAGGC | 2935 | AGG | + | GGGAUUAGUUAUUGGAAGGC | 6029 |
| GGATTAGTTATTGGAAGGCA | 2936 | GGG | + | GGAUUAGUUAUUGGAAGGCA | 6030 |
| TTAGTTATTGGAAGGCAGGG | 2937 | AGG | + | UUAGUUAUUGGAAGGCAGGG | 6031 |
| TAGTTATTGGAAGGCAGGGA | 2938 | GGG | + | UAGUUAUUGGAAGGCAGGGA | 6032 |
| TGGAAGGCAGGGAGGGACCC | 2939 | AGG | + | UGGAAGGCAGGGAGGGACCC | 6033 |
| AAGGCAGGGAGGGACCCAGG | 2940 | AGG | + | AAGGCAGGGAGGGACCCAGG | 6034 |
| GGAGGGACCCAGGAGGATGA | 2941 | AGG | + | GGAGGGACCCAGGAGGAUGA | 6035 |
| GAGGGACCCAGGAGGATGAA | 2942 | GGG | + | GAGGGACCCAGGAGGAUGAA | 6036 |
| TCTCTTCCCTTCATCCTCCT | 2943 | GGG | - | UCUCUUCCCUUCAUCCUCCU | 6037 |
| TTCTCTTCCCTTCATCCTCC | 2944 | TGG | - | UUCUCUUCCCUUCAUCCUCC | 6038 |
| GATGAAGGGAAGAGAATGCA | 2945 | AGG | + | GAUGAAGGGAAGAGAAUGCA | 6039 |
| ATGAAGGGAAGAGAATGCAA | 2946 | GGG | + | AUGAAGGGAAGAGAAUGCAA | 6040 |
| GGGAAGAGAATGCAAGGGAA | 2947 | AGG | + | GGGAAGAGAAUGCAAGGGAA | 6041 |
| AATGCAAGGGAAAGGAGTAA | 2948 | AGG | + | AAUGCAAGGGAAAGGAGUAA | 6042 |
| GCAAGGGAAAGGAGTAAAGG | 2949 | AGG | + | GCAAGGGAAAGGAGUAAAGG | 6043 |
| AGGGAAAGGAGTAAAGGAGG | 2950 | AGG | + | AGGGAAAGGAGUAAAGGAGG | 6044 |
| GAAAGGAGTAAAGGAGGAGG | 2951 | AGG | + | GAAAGGAGUAAAGGAGGAGG | 6045 |
| AGTAAAGGAGGAGGAGGTAG | 2952 | AGG | + | AGUAAAGGAGGAGGAGGUAG | 6046 |
| TATTAATTCCAGCACTTGTG | 2953 | AGG | + | UAUUAAUUCCAGCACUUGUG | 6047 |
| TAATTCCAGCACTTGTGAGG | 2954 | AGG | + | UAAUUCCAGCACUUGUGAGG | 6048 |
| AATTCCAGCACTTGTGAGGA | 2955 | GGG | + | AAUUCCAGCACUUGUGAGGA | 6049 |
| ATTCCAGCACTTGTGAGGAG | 2956 | GGG | + | AUUCCAGCACUUGUGAGGAG | 6050 |
| TGTCCCTCCTCACAAGTGC | 2957 | TGG | - | UGUCCCUCCUCACAAGUGC | 6051 |
| GACAGAGCTCTGTGAGTTCA | 2958 | AGG | + | GACAGAGCUCUGUGAGUUCA | 6052 |
| TGGAACTGACTATGCAGAGG | 2959 | GGG | - | UGGAACUGACUAUGCAGAGG | 6053 |
| CTGGAACTGACTATGCAGAG | 2960 | GGG | - | CUGGAACUGACUAUGCAGAG | 6054 |
| CCCTCTGCATAGTCAGTTCC | 2961 | AGG | + | CCCUCUGCAUAGUCAGUUCC | 6055 |
| CCTGGAACTGACTATGCAGA | 2962 | GGG | - | CCUGGAACUGACUAUGCAGA | 6056 |
| TCCTGGAACTGACTATGCAG | 2963 | AGG | - | UCCUGGAACUGACUAUGCAG | 6057 |
| GTCAGTTCCAGGATAGCCAA | 2964 | TGG | + | GUCAGUUCCAGGAUAGCCAA | 6058 |
| TATGTAGCCATTGGCTATCC | 2965 | TGG | - | UAUGUAGCCAUUGGCUAUCC | 6059 |
| GGGTCTCATTATGTAGCCAT | 2966 | TGG | - | GGGUCUCAUUAUGUAGCCAU | 6060 |
| ATGAGACCCTGTGTCAGAGA | 2967 | AGG | + | AUGAGACCCUGUGUCAGAGA | 6061 |
| AGACCCTGTGTCAGAGAAGG | 2968 | TGG | + | AGACCCUGUGUCAGAGAAGG | 6062 |
| CGGCCACCTTCTCTGACACA | 2969 | GGG | - | CGGCCACCUUCUCUGACACA | 6063 |
| CCTGTGTCAGAGAAGGTGGC | 2970 | CGG | + | CCUGUGUCAGAGAAGGUGGC | 6064 |
| CCGGCCACCTTCTCTGACAC | 2971 | AGG | - | CCGGCCACCUUCUCUGACAC | 6065 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| GTCAGAGAAGGTGGCCGGCG | 2972 | AGG | + | GUCAGAGAAGGUGGCCGGCG | 6066 |
| TCAGAGAAGGTGGCCGGCGA | 2973 | GGG | + | UCAGAGAAGGUGGCCGGCGA | 6067 |
| TAAGCATCAATATCCCTCGC | 2974 | CGG | - | UAAGCAUCAAUAUCCCUCGC | 6068 |
| TAACTCATTCAGCTGTGTGG | 2975 | TGG | - | UAACUCAUUCAGCUGUGUGG | 6069 |
| GTTTAACTCATTCAGCTGTG | 2976 | TGG | - | GUUUAACUCAUUCAGCUGUG | 6070 |
| AGTGCAAAAGTAGCAGGAAC | 2977 | AGG | - | AGUGCAAAAGUAGCAGGAAC | 6071 |
| ATTGAAAGTGCAAAAGTAGC | 2978 | AGG | - | AUUGAAAGUGCAAAAGUAGC | 6072 |
| ATGCTCCCAGATTACTTACA | 2979 | TGG | + | AUGCUCCCAGAUUACUUACA | 6073 |
| AAATTCCATGTAAGTAATCT | 2980 | GGG | - | AAAUUCCAUGUAAGUAAUCU | 6074 |
| TAAATTCCATGTAAGTAATC | 2981 | TGG | - | UAAAUUCCAUGUAAGUAAUC | 6075 |
| ATGGAATTTATATTTTATTG | 2982 | TGG | + | AUGGAAUUUAUAUUUUAUUG | 6076 |
| GAGGTTTGTCTATGATGTAC | 2983 | AGG | - | GAGGUUUGUCUAUGAUGUAC | 6077 |
| TTGGTTGAAAATTTTTCTTG | 2984 | AGG | - | UUGGUUGAAAAUUUUUCUUG | 6078 |
| AAATTTTCAACCAATAGTCC | 2985 | AGG | + | AAAUUUUCAACCAAUAGUCC | 6079 |
| GTTATTTTGCCTGGACTAT | 2986 | TGG | - | GUUAUUUUGCCUGGACUAU | 6080 |
| AAAAAGAGGTTATTTTTGCC | 2987 | TGG | - | AAAAAGAGGUUAUUUUUGCC | 6081 |
| AGAAAGAAAGAAAGAAAAAG | 2988 | AGG | - | AGAAAGAAAGAAAGAAAAAG | 6082 |
| TCTTTTTTTTTTTTTTTTTT | 2989 | TGG | + | UCUUUUUUUUUUUUUUUUUU | 6083 |
| TTTTTTTGGTTTTTTGAAAC | 2990 | AGG | + | UUUUUUUGGUUUUUUGAAAC | 6084 |
| TTTTTTGGTTTTTTGAAACA | 2991 | GGG | + | UUUUUUGGUUUUUUGAAACA | 6085 |
| AGGGTTTCTCTGTATAGCCC | 2992 | TGG | + | AGGGUUUCUCUGUAUAGCCC | 6086 |
| CTGTATAGCCCTGGCTGTCC | 2993 | TGG | + | CUGUAUAGCCCUGGCUGUCC | 6087 |
| AGTGAGTTCCAGGACAGCCA | 2994 | GGG | - | AGUGAGUUCCAGGACAGCCA | 6088 |
| AAGTGAGTTCCAGGACAGCC | 2995 | AGG | - | AAGUGAGUUCCAGGACAGCC | 6089 |
| TGGTGTACAAAGTGAGTTCC | 2996 | AGG | - | UGGUGUACAAAGUGAGUUCC | 6090 |
| TGGAACTCACTTTGTACACC | 2997 | AGG | + | UGGAACUCACUUUGUACACC | 6091 |
| ACTCACTTTGTACACCAGGC | 2998 | TGG | + | ACUCACUUUGUACACCAGGC | 6092 |
| TTCTGAGTTCGAGGCCAGCC | 2999 | TGG | - | UUCUGAGUUCGAGGCCAGCC | 6093 |
| CAGGTGGATTTCTGAGTTCG | 3000 | AGG | - | CAGGUGGAUUUCUGAGUUCG | 6094 |
| ACTCGGGAGGCAGAGGCAGG | 3001 | TGG | - | ACUCGGGAGGCAGAGGCAGG | 6095 |
| AGCACTCGGGAGGCAGAGGC | 3002 | AGG | - | AGCACUCGGGAGGCAGAGGC | 6096 |
| GCCTCTGCCTCCCGAGTGCT | 3003 | CGG | + | GCCUCUGCCUCCCGAGUGCU | 6097 |
| TCCGAGCACTCGGGAGGCAG | 3004 | AGG | - | UCCGAGCACUCGGGAGGCAG | 6098 |
| CTTTAATCCGAGCACTCGGG | 3005 | AGG | - | CUUUAAUCCGAGCACUCGGG | 6099 |
| CTCCCGAGTGCTCGGATTAA | 3006 | AGG | + | CUCCCGAGUGCUCGGAUUAA | 6100 |
| CGCCTTTAATCCGAGCACTC | 3007 | GGG | - | CGCCUUUAAUCCGAGCACUC | 6101 |
| ACGCCTTTAATCCGAGCACT | 3008 | CGG | - | ACGCCUUUAAUCCGAGCACU | 6102 |
| TATTTTTTGCGGGACGGTGG | 3009 | TGG | - | UAUUUUUUGCGGGACGGUGG | 6103 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| GGTTATTTTTGCGGGACGG | 3010 | TGG | - | GGUUAUUUUUGCGGGACGG | 6104 |
| ACAGGTTATTTTTGCGGGA | 3011 | CGG | - | ACAGGUUAUUUUUGCGGGA | 6105 |
| AAAAACAGGTTATTTTTGC | 3012 | GGG | - | AAAAACAGGUUAUUUUUGC | 6106 |
| CAAAACAGGTTATTTTTTG | 3013 | CGG | - | CAAAACAGGUUAUUUUUUG | 6107 |
| ATAATTAAAACAACAAAAAC | 3014 | AGG | - | AUAAUUAAAACAACAAAAAC | 6108 |
| TTTTTAAGATTTTATGTGTA | 3015 | TGG | + | UUUUUAAGAUUUUAUGUGUA | 6109 |
| TTTTAAGATTTTATGTGTAT | 3016 | GGG | + | UUUUAAGAUUUUAUGUGUAU | 6110 |
| CTGTGTACCACTTGTATGCT | 3017 | TGG | + | CUGUGUACCACUUGUAUGCU | 6111 |
| TTGGGCACCAAGCATACAAG | 3018 | TGG | - | UUGGGCACCAAGCAUACAAG | 6112 |
| TGTATGCTTGGTGCCCAAGA | 3019 | AGG | + | UGUAUGCUUGGUGCCCAAGA | 6113 |
| TGATCTGTTCTGTCCTTCTT | 3020 | GGG | - | UGAUCUGUUCUGUCCUUCUU | 6114 |
| ATGATCTGTTCTGTCCTTCT | 3021 | TGG | - | AUGAUCUGUUCUGUCCUUCU | 6115 |
| AGAAGGACAGAACAGATCAT | 3022 | AGG | + | AGAAGGACAGAACAGAUCAU | 6116 |
| GAAGGACAGAACAGATCATA | 3023 | GGG | + | GAAGGACAGAACAGAUCAUA | 6117 |
| GAACAGATCATAGGGTTTCC | 3024 | TGG | + | GAACAGAUCAUAGGGUUUCC | 6118 |
| AACAGATCATAGGGTTTCCT | 3025 | GGG | + | AACAGAUCAUAGGGUUUCCU | 6119 |
| TTTCCTGGGATAAGAGTTAT | 3026 | AGG | + | UUUCCUGGGAUAAGAGUUAU | 6120 |
| ACTCCTATAACTCTTATCCC | 3027 | AGG | - | ACUCCUAUAACUCUUAUCCC | 6121 |
| GATGACTGTAAGCCACCAAG | 3028 | TGG | + | GAUGACUGUAAGCCACCAAG | 6122 |
| GTAAGCCACCAAGTGGACGC | 3029 | TGG | + | GUAAGCCACCAAGUGGACGC | 6123 |
| TAAGCCACCAAGTGGACGCT | 3030 | GGG | + | UAAGCCACCAAGUGGACGCU | 6124 |
| AATTCCCAGCGTCCACTTGG | 3031 | TGG | - | AAUUCCCAGCGUCCACUUGG | 6125 |
| TTCAATTCCCAGCGTCCACT | 3032 | TGG | - | UUCAAUUCCCAGCGUCCACU | 6126 |
| GGACGCTGGGAATTGAACCT | 3033 | TGG | + | GGACGCUGGGAAUUGAACCU | 6127 |
| GGAATTGAACCTTGGTTAGC | 3034 | TGG | + | GGAAUUGAACCUUGGUUAGC | 6128 |
| GACACTCTTCCAGCTAACCA | 3035 | AGG | - | GACACUCUUCCAGCUAACCA | 6129 |
| GGGACTGGAATTAAAAATAC | 3036 | TGG | - | GGGACUGGAAUUAAAAAUAC | 6130 |
| CATAGACAAACAACGGGGAC | 3037 | TGG | - | CAUAGACAAACAACGGGGAC | 6131 |
| ATCTTCATAGACAAACAACG | 3038 | GGG | - | AUCUUCAUAGACAAACAACG | 6132 |
| AATCTTCATAGACAAACAAC | 3039 | GGG | - | AAUCUUCAUAGACAAACAAC | 6133 |
| AAATCTTCATAGACAAACAA | 3040 | CGG | - | AAAUCUUCAUAGACAAACAA | 6134 |
| TTGTCTATGAAGATTTTGCT | 3041 | TGG | + | UUGUCUAUGAAGAUUUUGCU | 6135 |
| TTTTGCTTGGTAGTCCAGTC | 3042 | TGG | + | UUUUGCUUGGUAGUCCAGUC | 6136 |
| CCAGTCTGGCTTTAAGAAAC | 3043 | AGG | + | CCAGUCUGGCUUUAAGAAAC | 6137 |
| CCTGTTTCTTAAAGCCAGAC | 3044 | TGG | - | CCUGUUUCUUAAAGCCAGAC | 6138 |
| CAGTCTGGCTTTAAGAAACA | 3045 | GGG | + | CAGUCUGGCUUUAAGAAACA | 6139 |
| AACAGGGTCTCATGCATCCC | 3046 | TGG | + | AACAGGGUCUCAUGCAUCCC | 6140 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| ATGGAAGTCTGAGCAAGCCA | 3047 | GGG | - | AUGGAAGUCUGAGCAAGCCA | 6141 |
| CATGGAAGTCTGAGCAAGCC | 3048 | AGG | - | CAUGGAAGUCUGAGCAAGCC | 6142 |
| CTCAGACTTCCATGCAGCTG | 3049 | AGG | + | CUCAGACUUCCAUGCAGCUG | 6143 |
| GACTTCCATGCAGCTGAGGA | 3050 | TGG | + | GACUUCCAUGCAGCUGAGGA | 6144 |
| TAAAGCCATCCTCAGCTGCA | 3051 | TGG | - | UAAAGCCAUCCUCAGCUGCA | 6145 |
| TCTACGAGGAAAAGGCAGGA | 3052 | GGG | - | UCUACGAGGAAAAGGCAGGA | 6146 |
| CTCTACGAGGAAAAGGCAGG | 3053 | AGG | - | CUCUACGAGGAAAAGGCAGG | 6147 |
| GCACTCTACGAGGAAAAGGC | 3054 | AGG | - | GCACUCUACGAGGAAAAGGC | 6148 |
| CTCAGCACTCTACGAGGAAA | 3055 | AGG | - | CUCAGCACUCUACGAGGAAA | 6149 |
| TGTAATCTCAGCACTCTACG | 3056 | AGG | - | UGUAAUCUCAGCACUCUACG | 6150 |
| GAGAAGTCTGCTGGTGGCAC | 3057 | AGG | - | GAGAAGUCUGCUGGUGGCAC | 6151 |
| TGTTAGGAGAAGTCTGCTGG | 3058 | TGG | - | UGUUAGGAGAAGUCUGCUGG | 6152 |
| TCTTGTTAGGAGAAGTCTGC | 3059 | TGG | - | UCUUGUUAGGAGAAGUCUGC | 6153 |
| GACTTCTCCTAACAAGAATG | 3060 | TGG | + | GACUUCUCCUAACAAGAAUG | 6154 |
| TCCTAACAAGAATGTGGCAC | 3061 | AGG | + | UCCUAACAAGAAUGUGGCAC | 6155 |
| CCTAACAAGAATGTGGCACA | 3062 | GGG | + | CCUAACAAGAAUGUGGCACA | 6156 |
| CCCTGTGCCACATTCTTGTT | 3063 | AGG | - | CCCUGUGCCACAUUCUUGUU | 6157 |
| AACAAGAATGTGGCACAGGG | 3064 | AGG | + | AACAAGAAUGUGGCACAGGG | 6158 |
| ATGTGGCACAGGGAGGCAAC | 3065 | TGG | + | AUGUGGCACAGGGAGGCAAC | 6159 |
| TGTGGCACAGGGAGGCAACT | 3066 | GGG | + | UGUGGCACAGGGAGGCAACU | 6160 |
| GAGGCAACTGGGAATCAAAC | 3067 | AGG | + | GAGGCAACUGGGAAUCAAAC | 6161 |
| CAACTGGGAATCAAACAGGA | 3068 | AGG | + | CAACUGGGAAUCAAACAGGA | 6162 |
| CTGGGAATCAAACAGGAAGG | 3069 | AGG | + | CUGGGAAUCAAACAGGAAGG | 6163 |
| AAACAGGAAGGAGGAGTAAA | 3070 | AGG | + | AAACAGGAAGGAGGAGUAAA | 6164 |
| AGGAAGGAGGAGTAAAAGGA | 3071 | AGG | + | AGGAAGGAGGAGUAAAAGGA | 6165 |
| GGAAGGAGGAGTAAAAGGAA | 3072 | GGG | + | GGAAGGAGGAGUAAAAGGAA | 6166 |
| GAAGGAGGAGTAAAAGGAAG | 3073 | GGG | + | GAAGGAGGAGUAAAAGGAAG | 6167 |
| GGAGGAGTAAAAGGAAGGGG | 3074 | AGG | + | GGAGGAGUAAAAGGAAGGGG | 6168 |
| GAGTAAAAGGAAGGGGAGGA | 3075 | AGG | + | GAGUAAAAGGAAGGGGAGGA | 6169 |
| AAAGGAAGGGGAGGAAGGAG | 3076 | AGG | + | AAAGGAAGGGGAGGAAGGAG | 6170 |
| GGGAGGAAGGAGAGGAGAAG | 3077 | TGG | + | GGGAGGAAGGAGAGGAGAAG | 6171 |
| GGAAGGAGAGGAGAAGTGGC | 3078 | AGG | + | GGAAGGAGAGGAGAAGUGGC | 6172 |
| AGGAGAGGAGAAGTGGCAGG | 3079 | AGG | + | AGGAGAGGAGAAGUGGCAGG | 6173 |
| GTGGCAGGAGGAGAAGAAAA | 3080 | AGG | + | GUGGCAGGAGGAGAAGAAAA | 6174 |
| GCAGGAGGAGAAGAAAAGG | 3081 | AGG | + | GCAGGAGGAGAAGAAAAGG | 6175 |
| GGAGGAGAAGAAAAGGAGG | 3082 | CGG | + | GGAGGAGAAGAAAAGGAGG | 6176 |
| AGAAAAGGAGGCGGAGAAA | 3083 | AGG | + | AGAAAAGGAGGCGGAGAAA | 6177 |
| AAAAGGAGGCGGAGAAAAGG | 3084 | TGG | + | AAAAGGAGGCGGAGAAAAGG | 6178 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| AGGCGGAGAAAAGGTGGTAG | 3085 | TGG | + | AGGCGGAGAAAAGGUGGUAG | 6179 |
| CGGAGAAAAGGTGGTAGTGG | 3086 | TGG | + | CGGAGAAAAGGUGGUAGUGG | 6180 |
| AGAAAAGGTGGTAGTGGTGG | 3087 | AGG | + | AGAAAAGGUGGUAGUGGUGG | 6181 |
| GGTGGTAGTGGTGGAGGAAG | 3088 | AGG | + | GGUGGUAGUGGUGGAGGAAG | 6182 |
| GGTAGTGGTGGAGGAAGAGG | 3089 | AGG | + | GGUAGUGGUGGAGGAAGAGG | 6183 |
| AGTGGTGGAGGAAGAGGAGG | 3090 | AGG | + | AGUGGUGGAGGAAGAGGAGG | 6184 |
| GGTGGAGGAAGAGGAGGAGG | 3091 | AGG | + | GGUGGAGGAAGAGGAGGAGG | 6185 |
| GGAGGAAGAGGAGGAGGAGG | 3092 | AGG | + | GGAGGAAGAGGAGGAGGAGG | 6186 |
| GGAAGAGGAGGAGGAGGAGG | 3093 | AGG | + | GGAAGAGGAGGAGGAGGAGG | 6187 |
| AGAGGAGGAGGAGGAGGAGG | 3094 | AGG | + | AGAGGAGGAGGAGGAGGAGG | 6188 |
| GGAGGAGGAGGAGGAGGAGG | 3095 | AGG | + | GGAGGAGGAGGAGGAGGAGG | 6189 |
| GGAGGAGGAGGAGGAGGAGG | 3096 | AGG | + | GGAGGAGGAGGAGGAGGAGG | 6190 |
| GAGGAGGAGGAGGAGGAGGA | 3097 | GGG | + | GAGGAGGAGGAGGAGGAGGA | 6191 |
| AGGAGGAGGAGGAGGAGGAG | 3098 | GGG | + | AGGAGGAGGAGGAGGAGGAG | 6192 |
| GGAGGAGGAGGAGGAGGAGG | 3099 | GGG | + | GGAGGAGGAGGAGGAGGAGG | 6193 |
| GAGGGGGACTTAATCAGTAA | 3100 | AGG | + | GAGGGGGACUUAAUCAGUAA | 6194 |
| ACTTAATCAGTAAAGGAAAA | 3101 | AGG | + | ACUUAAUCAGUAAAGGAAAA | 6195 |
| AAAAGGCTGAGCTCAGTCCT | 3102 | TGG | + | AAAAGGCUGAGCUCAGUCCU | 6196 |
| CTCAGTCCTTGGAACCTACA | 3103 | TGG | + | CUCAGUCCUUGGAACCUACA | 6197 |
| GTCCTTGGAACCTACATGGT | 3104 | AGG | + | GUCCUUGGAACCUACAUGGU | 6198 |
| CTCCTACCATGTAGGTTCCA | 3105 | AGG | - | CUCCUACCAUGUAGGUUCCA | 6199 |
| CTCATTCTCTCCTACCATGT | 3106 | AGG | - | CUCAUUCUCUCCUACCAUGU | 6200 |
| GTTTCCTCTGATCCCCACAC | 3107 | TGG | + | GUUUCCUCUGAUCCCCACAC | 6201 |
| TGCTCCAGTGTGGGGATCAG | 3108 | AGG | - | UGCUCCAGUGUGGGGAUCAG | 6202 |
| TGATCCCCACACTGGAGCAA | 3109 | TGG | + | UGAUCCCCACACUGGAGCAA | 6203 |
| GGCACCATTGCTCCAGTGTG | 3110 | GGG | - | GGCACCAUUGCUCCAGUGUG | 6204 |
| TGGCACCATTGCTCCAGTGT | 3111 | GGG | - | UGGCACCAUUGCUCCAGUGU | 6205 |
| ATGGCACCATTGCTCCAGTG | 3112 | TGG | - | AUGGCACCAUUGCUCCAGUG | 6206 |
| GAAGTGGGAGAGTGATGTGA | 3113 | TGG | - | GAAGUGGGAGAGUGAUGUGA | 6207 |
| TGTGAGGAGTTGGGTGAAGT | 3114 | GGG | - | UGUGAGGAGUUGGGUGAAGU | 6208 |
| TTGTGAGGAGTTGGGTGAAG | 3115 | TGG | - | UUGUGAGGAGUUGGGUGAAG | 6209 |
| TTTTATTTTGTGAGGAGTT | 3116 | GGG | - | UUUUAUUUUGUGAGGAGUU | 6210 |
| TTTTTATTTTGTGAGGAGT | 3117 | TGG | - | UUUUUAUUUUGUGAGGAGU | 6211 |
| TTTTGTTTTTATTTTGTG | 3118 | AGG | - | UUUUGUUUUUAUUUUGUG | 6212 |
| TTAAAAAGAAAGCTGTAGC | 3119 | CGG | + | UUAAAAAGAAAGCUGUAGC | 6213 |
| TAAAAAGAAAGCTGTAGCC | 3120 | GGG | + | UAAAAAGAAAGCUGUAGCC | 6214 |
| AAGAAAGCTGTAGCCGGGCG | 3121 | TGG | + | AAGAAAGCUGUAGCCGGGCG | 6215 |

TABLE 3-continued

Mouse Rs1 Intron 1 Guide RNA Target Sequences and Guide Sequences.

| Target | SEQ ID NO. | PAM | Direction | Guide | SEQ ID NO. |
|---|---|---|---|---|---|
| AAAGCTGTAGCCGGGCGTGG | 3122 | TGG | + | AAAGCUGUAGCCGGGCGUGG | 6216 |
| AAAGTGTGTGCCACCACGCC | 3123 | CGG | - | AAAGUGUGUGCCACCACGCC | 6217 |
| GTGGCACACACTTTTAATCC | 3124 | CGG | + | GUGGCACACACUUUUAAUCC | 6218 |
| ACACTTTTAATCCCGGCACT | 3125 | TGG | + | ACACUUUUAAUCCCGGCACU | 6219 |
| CACTTTTAATCCCGGCACTT | 3126 | GGG | + | CACUUUUAAUCCCGGCACUU | 6220 |
| TTTTAATCCCGGCACTTGGG | 3127 | AGG | + | UUUUAAUCCCGGCACUUGGG | 6221 |
| TCCCGGCACTTGGGAGGCAG | 3128 | AGG | + | UCCCGGCACUUGGGAGGCAG | 6222 |
| GCCTCTGCCTCCCAAGTGCC | 3129 | GGG | - | GCCUCUGCCUCCCAAGUGCC | 6223 |
| TGCCTCTGCCTCCCAAGTGC | 3130 | CGG | - | UGCCUCUGCCUCCCAAGUGC | 6224 |
| ACTTGGGAGGCAGAGGCAAG | 3131 | CGG | + | ACUUGGGAGGCAGAGGCAAG | 6225 |
| CAAGCGGATTTCTGAGTTCG | 3132 | AGG | + | CAAGCGGAUUUCUGAGUUCG | 6226 |
| TTCTGAGTTCGAGGCCAGCT | 3133 | TGG | + | UUCUGAGUUCGAGGCCAGCU | 6227 |
| ACTCACTTTGTAGACCAAGC | 3134 | TGG | - | ACUCACUUUGUAGACCAAGC | 6228 |
| TGGTCTACAAAGTGAGTTCC | 3135 | AGG | + | UGGUCUACAAAGUGAGUUCC | 6229 |
| AAGTGAGTTCCAGGACAGCC | 3136 | AGG | + | AAGUGAGUUCCAGGACAGCC | 6230 |
| AGTGAGTTCCAGGACAGCCA | 3137 | GGG | + | AGUGAGUUCCAGGACAGCCA | 6231 |
| CTGTGTAGCCCTGGCTGTCC | 3138 | TGG | - | CUGUGUAGCCCUGGCUGUCC | 6232 |
| AGGGTTTCTCTGTGTAGCCC | 3139 | TGG | - | AGGGUUUCUCUGUGUAGCCC | 6233 |
| TCTTTTGGTTTTTCAAGACA | 3140 | GGG | - | UCUUUUGGUUUUUCAAGACA | 6234 |
| TTCTTTTGGTTTTTCAAGAC | 3141 | AGG | - | UUCUUUUGGUUUUUCAAGAC | 6235 |
| ACAGCTTTCTTTTTTCTTT | 3142 | TGG | - | ACAGCUUUCUUUUUUCUUU | 6236 |
| TATATTAATATAGCAAAGCA | 3143 | GGG | - | UAUAUUAAUAUAGCAAAGCA | 6237 |
| ATATATTAATATAGCAAAGC | 3144 | AGG | - | AUAUAUUAAUAUAGCAAAGC | 6238 |
| TGTTTTTCTTATAGAATTA | 3145 | TGG | - | UGUUUUUCUUAUAGAAUUA | 6239 |
| TTCTGGAGGGAGGAAAAGGA | 3146 | TGG | - | UUCUGGAGGGAGGAAAAGGA | 6240 |
| CTCATTCTGGAGGGAGGAAA | 3147 | AGG | - | CUCAUUCUGGAGGGAGGAAA | 6241 |

B. Other Nuclease Agents and Target Sequences for Nuclease Agents

Any nuclease agent that induces a nick or double-strand break at a desired target sequence can be used in the methods and compositions disclosed herein. A naturally occurring or native nuclease agent can be employed so long as the nuclease agent induces a nick or double-strand break at a desired target sequence. Alternatively, a modified or engineered nuclease agent can be employed. An "engineered nuclease agent" includes a nuclease that is engineered (modified or derived) from its native form to specifically recognize and induce a nick or double-strand break in the desired target sequence. Thus, an engineered nuclease agent can be derived from a native, naturally occurring nuclease agent or it can be artificially created or synthesized. The engineered nuclease can induce a nick or double-strand break in a target sequence, for example, wherein the target sequence is not a sequence that would have been recognized by a native (non-engineered or non-modified) nuclease agent. The modification of the nuclease agent can be as little as one amino acid in a protein cleavage agent or one nucleotide in a nucleic acid cleavage agent. Producing a nick or double-strand break at a target sequence or other DNA can be referred to herein as "cutting" or "cleaving" the target sequence or other DNA.

Active variants and fragments of the exemplified target sequences are also provided. Such active variants can comprise at least 65%, 70%, 75%, 80%, 85%, 90%, 91%, 92%, 93%, 94%, 95%, 96%, 97%, 98%, 99% or more sequence identity to the given target sequence, wherein the active variants retain biological activity and hence are capable of being recognized and cleaved by a nuclease agent in a sequence-specific manner. Assays to measure the double-strand break of a target sequence by a nuclease agent are well-known. See, e.g., Frendewey et al. (2010) Methods in Enzymology 476:295-307, which is herein incorporated by reference herein in its entirety for all purposes.

The target sequence of the nuclease agent can be positioned anywhere in or near the target locus. The target sequence can be located within a coding region of a gene, or within regulatory regions that influence the expression of the gene. A target sequence of the nuclease agent can be located in an intron, an exon, a promoter, an enhancer, a regulatory region, or any non-protein coding region.

One type of nuclease agent is a Transcription Activator-Like Effector Nuclease (TALEN). TAL effector nucleases are a class of sequence-specific nucleases that can be used to make double-strand breaks at specific target sequences in the genome of a prokaryotic or eukaryotic organism. TAL effector nucleases are created by fusing a native or engineered transcription activator-like (TAL) effector, or functional part thereof, to the catalytic domain of an endonuclease, such as, for example, FokI. The unique, modular TAL effector DNA binding domain allows for the design of proteins with potentially any given DNA recognition specificity. Thus, the DNA binding domains of the TAL effector nucleases can be engineered to recognize specific DNA target sites and thus, used to make double-strand breaks at desired target sequences. See WO 2010/079430; Morbitzer et al. (2010) *Proc. Natl. Acad. Sci. U.S.A.* 107(50):21617-21622; Scholze & Boch (2010) *Virulence* 1:428-432; Christian et al. *Genetics* (2010) 186:757-761; Li et al. (2010) *Nucleic Acids Res.* (2010) doi:10.1093/nar/gkq704; and Miller et al. (2011) *Nat. Biotechnol.* 29:143-148, each of which is herein incorporated by reference in its entirety for all purposes.

Examples of suitable TAL nucleases, and methods for preparing suitable TAL nucleases, are disclosed, e.g., in US 2011/0239315 A1, US 2011/0269234 A1, US 2011/0145940 A1, US 2003/0232410 A1, US 2005/0208489 A1, US 2005/0026157 A1, US 2005/0064474 A1, US 2006/0188987 A1, and US 2006/0063231 A1, each of which is herein incorporated by reference in its entirety for all purposes. In various embodiments, TAL effector nucleases are engineered that cut in or near a target nucleic acid sequence in, e.g., a locus of interest or a genomic locus of interest, wherein the target nucleic acid sequence is at or near a sequence to be modified by a targeting vector. The TAL nucleases suitable for use with the various methods and compositions provided herein include those that are specifically designed to bind at or near target nucleic acid sequences to be modified by targeting vectors as described herein.

In some TALENs, each monomer of the TALEN comprises 33-35 TAL repeats that recognize a single base pair via two hypervariable residues. In some TALENs, the nuclease agent is a chimeric protein comprising a TAL-repeat-based DNA binding domain operably linked to an independent nuclease such as a FokI endonuclease. For example, the nuclease agent can comprise a first TAL-repeat-based DNA binding domain and a second TAL-repeat-based DNA binding domain, wherein each of the first and the second TAL-repeat-based DNA binding domains is operably linked to a FokI nuclease, wherein the first and the second TAL-repeat-based DNA binding domain recognize two contiguous target DNA sequences in each strand of the target DNA sequence separated by a spacer sequence of varying length (12-20 bp), and wherein the FokI nuclease subunits dimerize to create an active nuclease that makes a double strand break at a target sequence.

The nuclease agent employed in the various methods and compositions disclosed herein can further comprise a zinc-finger nuclease (ZFN). In some ZFNs, each monomer of the ZFN comprises 3 or more zinc finger-based DNA binding domains, wherein each zinc finger-based DNA binding domain binds to a 3 bp subsite. In other ZFNs, the ZFN is a chimeric protein comprising a zinc finger-based DNA binding domain operably linked to an independent nuclease such as a FokI endonuclease. For example, the nuclease agent can comprise a first ZFN and a second ZFN, wherein each of the first ZFN and the second ZFN is operably linked to a FokI nuclease subunit, wherein the first and the second ZFN recognize two contiguous target DNA sequences in each strand of the target DNA sequence separated by about 5-7 bp spacer, and wherein the FokI nuclease subunits dimerize to create an active nuclease that makes a double strand break. See, e.g., US20060246567; US20080182332; US20020081614; US20030021776; WO/2002/057308A2; US20130123484; US20100291048; WO/2011/017293A2; and Gaj et al. (2013) Trends Biotechnol., 31(7):397-405, each of which is herein incorporated by reference in its entirety for all purposes.

Active variants and fragments of nuclease agents (i.e., an engineered nuclease agent) are also provided. Such active variants can comprise at least 65%, 70%, 75%, 80%, 85%, 90%, 91%, 92%, 93%, 94%, 95%, 96%, 97%, 98%, 99% or more sequence identity to the native nuclease agent, wherein the active variants retain the ability to cut at a desired target sequence and hence retain nick or double-strand-break-inducing activity. For example, any of the nuclease agents described herein can be modified from a native endonuclease sequence and designed to recognize and induce a nick or double-strand break at a target sequence that was not recognized by the native nuclease agent. Thus, some engineered nucleases have a specificity to induce a nick or double-strand break at a target sequence that is different from the corresponding native nuclease agent target sequence. Assays for nick or double-strand-break-inducing activity are known and generally measure the overall activity and specificity of the endonuclease on DNA substrates containing the target sequence.

The nuclease agent may be introduced into the cell or animal by any known means. A polypeptide encoding the nuclease agent may be directly introduced into the cell or animal. Alternatively, a polynucleotide encoding the nuclease agent can be introduced into the cell or animal. When a polynucleotide encoding the nuclease agent is introduced, the nuclease agent can be transiently, conditionally, or constitutively expressed within the cell. The polynucleotide encoding the nuclease agent can be contained in an expression cassette and be operably linked to a conditional promoter, an inducible promoter, a constitutive promoter, or a tissue-specific promoter. Examples of promoters are discussed in further detail elsewhere herein. Alternatively, the nuclease agent can be introduced into the cell as an mRNA encoding the nuclease agent.

A polynucleotide encoding a nuclease agent can be stably integrated in the genome of a cell and operably linked to a promoter active in the cell. Alternatively, a polynucleotide encoding a nuclease agent can be in an expression vector or a targeting vector.

When the nuclease agent is provided to the cell through the introduction of a polynucleotide encoding the nuclease agent, such a polynucleotide encoding a nuclease agent can be modified to substitute codons having a higher frequency of usage in the cell of interest, as compared to the naturally occurring polynucleotide sequence encoding the nuclease agent. For example, the polynucleotide encoding the nuclease agent can be modified to substitute codons having a higher frequency of usage in a given eukaryotic cell of interest, including a human cell, a non-human cell, a mammalian cell, a rodent cell, a mouse cell, a rat cell or any other host cell of interest, as compared to the naturally occurring polynucleotide sequence.

The term "target sequence for a nuclease agent" includes a DNA sequence at which a nick or double-strand break is induced by a nuclease agent. The target sequence for a nuclease agent can be endogenous (or native) to the cell or the target sequence can be exogenous to the cell. A target sequence that is exogenous to the cell is not naturally occurring in the genome of the cell. The target sequence can also exogenous to the polynucleotides of interest that one desires to be positioned at the target locus. In some cases, the target sequence is present only once in the genome of the host cell.

The length of the target sequence can vary, and includes, for example, target sequences that are about 30-36 bp for a zinc finger nuclease (ZFN) pair (i.e., about 15-18 bp for each ZFN), about 36 bp for a Transcription Activator-Like Effector Nuclease (TALEN), or about 20 bp for a CRISPR/Cas9 guide RNA.

VI. Cells or Animals or Genomes Comprising Nucleic Acid Constructs and/or Nuclease Agents or Nucleic Acids Encoding Nuclease Agents Genomes, cells, and animals produced by the methods disclosed herein are also provided. Likewise, genomes, cells, and animals comprising the nucleic acid constructs comprising a retinoschisin coding sequence (i.e., encoding a retinoschisin protein or fragment or variant thereof) for integration into and expression from a target genomic locus, vectors, lipid nanoparticles, or compositions as described herein are also provided. Likewise, genomes, cells, and animals comprising the described nuclease agents or nucleic acids encoding the nuclease agents (e.g., targeting an endogenous RS1 locus) or vectors, lipid nanoparticles, or compositions as described herein are also provided. The genomes, cells, or animals can comprise the nucleic acid construct genomically integrated at a target genomic locus (e.g., at an RS1 locus) and can express the retinoschisin protein or fragment or variant thereof. The retinoschisin coding sequence can be operably linked to an endogenous promoter at the target genomic locus upon integration into the target genomic locus, or it can be operably linked to an exogenous promoter present in the nucleic acid construct. If the nucleic acid construct is a bidirectional nucleic acid construct disclosed herein, the genome, cell, or animal can express the first retinoschisin protein or fragment or variant thereof or can express the second retinoschisin protein or fragment or variant thereof. In some genomes, cells, or animals, the target genomic locus is an RS1 locus. For example, the nucleic acid construct can be genomically integrated in intron 1 of the endogenous RS1 locus. Endogenous RS1 exon 1 can then splice into the coding sequence for the retinoschisin protein or fragment or variant thereof in the nucleic acid construct. In a specific example, the modified RS1 locus comprising the genomically integrated nucleic acid construct encodes a protein comprising, consisting essentially of, or consisting of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 2 or 4. In a specific example, the modified RS1 locus comprising the genomically integrated nucleic acid construct comprises an RS1 coding sequence comprising, consisting essentially of, or consisting of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 6, 11, or 12.

In some genomes, cells, or animals, integration of the nucleic acid construct into the endogenous RS1 locus prevents transcription of the endogenous RS1 gene downstream of the integration site. For example, the integration of the nucleic acid construct into the endogenous RS1 locus can reduce or eliminate expression of the endogenous retinoschisin protein and replace it with expression of the retinoschisin protein or fragment or variant thereof encoded by the nucleic acid construct. In one example, integration of the nucleic acid construct into the endogenous RS1 locus reduces expression of the endogenous retinoschisin protein. In another example, integration of the nucleic acid construct into the endogenous RS1 locus eliminates expression of the endogenous retinoschisin protein. In a specific example, the endogenous RS1 locus comprises a mutated RS1 gene comprising a mutation that causes X-linked juvenile retinoschisis, and expression of the genomically integrated nucleic acid construct reduces or eliminates expression of the mutated RS1 gene.

The target genomic locus at which the nucleic acid construct is stably integrated can be heterozygous for the retinoschisin coding sequence from the nucleic acid construct or homozygous for the retinoschisin coding sequence from the nucleic acid construct. A diploid organism has two alleles at each genetic locus. Each pair of alleles represents the genotype of a specific genetic locus. Genotypes are described as homozygous if there are two identical alleles at a particular locus and as heterozygous if the two alleles differ. An animal comprising a genomically integrated nucleic acid construct as described herein can comprise the nucleic acid construct in a target genomic locus in its germline.

The genomes, cells, or animals provided herein can be, for example, eukaryotic, including, for example, animal, mammalian, non-human mammalian, and human. The term "animal" includes mammals, fishes, and birds. A mammal can be, for example, a non-human mammal, a human, a rodent, a rat, a mouse, or a hamster. Other non-human mammals include, for example, non-human primates, monkeys, apes, cats, dogs, rabbits, horses, bulls, deer, bison, livestock (e.g., bovine species such as cows, steer, and so forth; ovine species such as sheep, goats, and so forth; and porcine species such as pigs and boars). Birds include, for example, chickens, turkeys, ostrich, geese, ducks, and so forth. Domesticated animals and agricultural animals are also included. The term "non-human" excludes humans.

The cells can be isolated cells (e.g., in vitro) or can be in vivo within an animal. Cells can also be any type of undifferentiated or differentiated state. For example, a cell can be a totipotent cell, a pluripotent cell (e.g., a human pluripotent cell or a non-human pluripotent cell such as a mouse embryonic stem (ES) cell or a rat ES cell), or a non-pluripotent cell. Totipotent cells include undifferentiated cells that can give rise to any cell type, and pluripotent cells include undifferentiated cells that possess the ability to develop into more than one differentiated cell types.

The cells provided herein can also be germ cells (e.g., sperm or oocytes). The cells can be mitotically competent cells or mitotically-inactive cells, meiotically competent cells or meiotically-inactive cells. Similarly, the cells can also be primary somatic cells or cells that are not a primary somatic cell. Somatic cells include any cell that is not a gamete, germ cell, gametocyte, or undifferentiated stem cell.

For example, the cells can be liver cells, kidney cells, hematopoietic cells, endothelial cells, epithelial cells, fibroblasts, mesenchymal cells, keratinocytes, blood cells, melanocytes, monocytes, mononuclear cells, monocytic precursors, B cells, erythroid-megakaryocytic cells, eosinophils, macrophages, T cells, islet beta cells, exocrine cells, pancreatic progenitors, endocrine progenitors, adipocytes, preadipocytes, neurons, glial cells, neural stem cells, neurons, hepatoblasts, hepatocytes, cardiomyocytes, skeletal myoblasts, smooth muscle cells, ductal cells, acinar cells, alpha cells, beta cells, delta cells, PP cells, cholangiocytes, white or brown adipocytes, or ocular cells (e.g., trabecular meshwork cells, retinal pigment epithelial cells, retinal microvascular endothelial cells, retinal pericyte cells, conjunctival epithelial cells, conjunctival fibroblasts, iris pigment epithelial cells, keratocytes, lens epithelial cells, non-pigment ciliary epithelial cells, ocular choroid fibroblasts, photoreceptor cells, ganglion cells, bipolar cells, horizontal cells, or amacrine cells). For example, the cells can be eye cells, such as retinal cells (e.g., photoreceptors).

The cells provided herein can be normal, healthy cells, or can be diseased or mutant-bearing cells. For example, the cells can comprise one or more mutations associated with or that cause XLRS (e.g., encoding a R141C substitution in the retinoschisin protein).

The animals provided herein can be humans or they can be non-human animals. Non-human animals comprising a nucleic acid or expression cassette as described herein can be made by the methods described elsewhere herein. The term "animal" includes mammals, fishes, and birds. Mammals include, for example, humans, non-human primates, monkeys, apes, cats, dogs, horses, bulls, deer, bison, sheep, rabbits, rodents (e.g., mice, rats, hamsters, and guinea pigs), and livestock (e.g., bovine species such as cows and steer; ovine species such as sheep and goats; and porcine species such as pigs and boars). Birds include, for example, chickens, turkeys, ostrich, geese, and ducks. Domesticated animals and agricultural animals are also included. The term "non-human animal" excludes humans. Particular examples of non-human animals include rodents, such as mice and rats.

Non-human animals can be from any genetic background. For example, suitable mice can be from a 129 strain, a C57BL/6 strain, a mix of 129 and C57BL/6, a BALB/c strain, or a Swiss Webster strain. Examples of 129 strains include 129P1, 129P2, 129P3, 129X1, 129S1 (e.g., 129S1/SV, 129S1/Svlm), 129S2, 129S4, 129S5, 12959/SvEvH, 129S6 (129/SvEvTac), 129S7, 129S8, 129T1, and 129T2. See, e.g., Festing et al. (1999) *Mammalian Genome* 10:836, herein incorporated by reference in its entirety for all purposes. Examples of C57BL strains include C57BL/A, C57BL/An, C57BL/GrFa, C57BL/Kal_wN, C57BL/6, C57BL/6J, C57BL/6ByJ, C57BL/6NJ, C57BL/10, C57BL/10ScSn, C57BL/10Cr, and C57BL/Ola. Suitable mice can also be from a mix of an aforementioned 129 strain and an aforementioned C57BL/6 strain (e.g., 50% 129 and 50% C57BL/6). Likewise, suitable mice can be from a mix of aforementioned 129 strains or a mix of aforementioned BL/6 strains (e.g., the 129S6 (129/SvEvTac) strain).

Similarly, rats can be from any rat strain, including, for example, an ACI rat strain, a Dark Agouti (DA) rat strain, a Wistar rat strain, a LEA rat strain, a Sprague Dawley (SD) rat strain, or a Fischer rat strain such as Fisher F344 or Fisher F6. Rats can also be obtained from a strain derived from a mix of two or more strains recited above. For example, a suitable rat can be from a DA strain or an ACI strain. The ACI rat strain is characterized as having black agouti, with white belly and feet and an RT1$^{av1}$ aplotype. Such strains are available from a variety of sources including Harlan Laboratories. The Dark Agouti (DA) rat strain is characterized as having an agouti coat and an RT1$^{av1}$ haplotype. Such rats are available from a variety of sources including Charles River and Harlan Laboratories. In some cases, suitable rats can be from an inbred rat strain. See, e.g., US 2014/0235933, herein incorporated by reference in its entirety for all purposes.

VII. Methods for Modifying a Target Genomic Locus, Expressing Retinoschisin in a Cell, or Treating XLRS Also provided herein are methods for modifying a target genomic locus or methods for expressing retinoschisin in a cell using the nucleic acid constructs comprising a retinoschisin coding sequence (i.e., encoding a retinoschisin protein or fragment or variant thereof) for integration into and expression from a target genomic locus as provided herein. Also provided herein are methods for modifying a target genomic locus or methods for expressing retinoschisin in a cell using the nuclease agents (or nucleic acids encoding) disclosed herein in combination with the nucleic acid constructs comprising a retinoschisin coding sequence (i.e., encoding a retinoschisin protein or fragment or variant thereof) for integration into and expression from a target genomic locus as provided herein. Also provided herein are methods for modifying a target genomic locus using the nuclease agents (or nucleic acids encoding) disclosed herein.

The methods can be, for example, methods of modifying a target genomic locus (e.g., an endogenous RS1 locus). Some such methods comprise administering a nuclease agent or a nucleic acid encoding the nuclease agent, wherein the nuclease agent targets a nuclease target sequence in the target genomic locus and cleaves the target genomic locus.

The methods can be, for example, methods of integrating a coding sequence for a retinoschisin protein or fragment thereof into a target genomic locus and expressing the retinoschisin protein or fragment thereof in a cell. Some such methods comprise administering a nucleic acid construct, vector, or lipid nanoparticle as described elsewhere herein to a cell. The coding sequence can then be integrated into the target genomic locus, and the retinoschisin protein or fragment thereof is expressed in the cell. The retinoschisin coding sequence can be operably linked to an endogenous promoter at the target genomic locus upon integration into the target genomic locus, or it can be operably linked to an exogenous promoter present in the nucleic acid construct. Some such methods comprise administering to a cell a nucleic acid construct, vector, or lipid nanoparticle as described elsewhere herein and a nuclease agent or a nucleic acid encoding the nuclease agent, wherein the nuclease agent targets a nuclease target sequence in the target genomic locus. The nuclease agent can cleave the target genomic locus, and the coding sequence from the nucleic acid construct can be integrated into the target genomic locus so that the retinoschisin protein or fragment thereof is expressed in the cell. Some such methods comprise administering to a cell a composition comprising a nucleic acid construct, vector, or lipid nanoparticle disclosed herein and a nuclease agent or a nucleic acid encoding the nuclease agent, wherein the nuclease agent targets a nuclease target sequence in the target genomic locus. The nuclease agent can cleave the target genomic locus, and the coding sequence from the nucleic acid construct can be integrated into the target genomic locus so that the retinoschisin protein or fragment thereof is expressed in the cell. The nuclease agent or nucleic acid encoding the nuclease agent can be administered, for example, in a vector (e.g., viral vector such as an AAV vector) or in a lipid nanoparticle.

The cells in the above methods can be isolated cells (e.g., in vitro) or can be in vivo within an animal. The cells can also be any type of undifferentiated or differentiated state. For example, a cell can be a totipotent cell, a pluripotent cell (e.g., a human pluripotent cell or a non-human pluripotent cell such as a mouse embryonic stem (ES) cell or a rat ES cell), or a non-pluripotent cell. Totipotent cells include undifferentiated cells that can give rise to any cell type, and pluripotent cells include undifferentiated cells that possess the ability to develop into more than one differentiated cell types.

The cells can also be germ cells (e.g., sperm or oocytes). The cells can be mitotically competent cells or mitotically-inactive cells, meiotically competent cells or meiotically-inactive cells. Similarly, the cells can also be primary somatic cells or cells that are not a primary somatic cell. Somatic cells include any cell that is not a gamete, germ cell, gametocyte, or undifferentiated stem cell. For example, the cells can be liver cells, kidney cells, hematopoietic cells, endothelial cells, epithelial cells, fibroblasts, mesenchymal cells, keratinocytes, blood cells, melanocytes, monocytes, mononuclear cells, monocytic precursors, B cells, erythroid-megakaryocytic cells, eosinophils, macrophages, T cells, islet beta cells, exocrine cells, pancreatic progenitors, endocrine progenitors, adipocytes, preadipocytes, neurons, glial cells, neural stem cells, neurons, hepatoblasts, hepatocytes, cardiomyocytes, skeletal myoblasts, smooth muscle cells, ductal cells, acinar cells, alpha cells, beta cells, delta cells, PP cells, cholangiocytes, white or brown adipocytes, or ocular cells (e.g., trabecular meshwork cells, retinal pigment epithelial cells, retinal microvascular endothelial cells, retinal pericyte cells, conjunctival epithelial cells, conjunctival fibroblasts, iris pigment epithelial cells, keratocytes, lens epithelial cells, non-pigment ciliary epithelial cells, ocular choroid fibroblasts, photoreceptor cells, ganglion cells, bipolar cells, horizontal cells, or amacrine cells). For example, the cells can be eye cells, such as retinal cells (e.g., photoreceptors).

The cells provided herein can be normal, healthy cells, or can be diseased or mutant-bearing cells. For example, the cells can comprise one or more mutations associated with or that cause XLRS (e.g., R141C).

The cells can be, for example, eukaryotic, including, for example, animal, mammalian, non-human mammalian, and human. In a specific example, the cells are human cells. The term "animal" includes mammals, fishes, and birds. A mammal can be, for example, a non-human mammal, a human, a rodent, a rat, a mouse, or a hamster. Other non-human mammals include, for example, non-human primates, monkeys, apes, cats, dogs, rabbits, horses, bulls, deer, bison, livestock (e.g., bovine species such as cows, steer, and so forth; ovine species such as sheep, goats, and so forth; and porcine species such as pigs and boars). Birds include, for example, chickens, turkeys, ostrich, geese, ducks, and so forth. Domesticated animals and agricultural animals are also included. The term "non-human" excludes humans.

The cells can be in vivo within an animal. The animal can be a human or can be a non-human animal. Non-human animals comprising a nucleic acid or expression cassette as described herein can be made by the methods described elsewhere herein. The term "animal" includes mammals, fishes, and birds. Mammals include, for example, humans, non-human primates, monkeys, apes, cats, dogs, horses, bulls, deer, bison, sheep, rabbits, rodents (e.g., mice, rats, hamsters, and guinea pigs), and livestock (e.g., bovine species such as cows and steer; ovine species such as sheep and goats; and porcine species such as pigs and boars). Birds include, for example, chickens, turkeys, ostrich, geese, and ducks. Domesticated animals and agricultural animals are also included. The term "non-human animal" excludes humans. Particular examples of non-human animals include rodents, such as mice and rats.

Non-human animals can be from any genetic background. For example, suitable mice can be from a 129 strain, a C57BL/6 strain, a mix of 129 and C57BL/6, a BALB/c strain, or a Swiss Webster strain. Examples of 129 strains include 129P1, 129P2, 129P3, 129X1, 129S1 (e.g., 129S1/SV, 129S1/Svlm), 129S2, 129S4, 129S5, 12959/SvEvH, 129S6 (129/SvEvTac), 129S7, 129S8, 129T1, and 129T2. See, e.g., Festing et al. (1999) *Mammalian Genome* 10:836, herein incorporated by reference in its entirety for all purposes. Examples of C57BL strains include C57BL/A, C57BL/An, C57BL/GrFa, C57BL/Kal_wN, C57BL/6, C57BL/6J, C57BL/6ByJ, C57BL/6NJ, C57BL/10, C57BL/10ScSn, C57BL/10Cr, and C57BL/Ola. Suitable mice can also be from a mix of an aforementioned 129 strain and an aforementioned C57BL/6 strain (e.g., 50% 129 and 50% C57BL/6). Likewise, suitable mice can be from a mix of aforementioned 129 strains or a mix of aforementioned BL/6 strains (e.g., the 129S6 (129/SvEvTac) strain).

Similarly, rats can be from any rat strain, including, for example, an ACI rat strain, a Dark Agouti (DA) rat strain, a Wistar rat strain, a LEA rat strain, a Sprague Dawley (SD) rat strain, or a Fischer rat strain such as Fisher F344 or Fisher F6. Rats can also be obtained from a strain derived from a mix of two or more strains recited above. For example, a suitable rat can be from a DA strain or an ACI strain. The ACI rat strain is characterized as having black agouti, with white belly and feet and an $RT1^{av1}$ haplotype. Such strains are available from a variety of sources including Harlan Laboratories. The Dark Agouti (DA) rat strain is characterized as having an agouti coat and an $RT1^{av1}$ haplotype. Such rats are available from a variety of sources including Charles River and Harlan Laboratories. In some cases, suitable rats can be from an inbred rat strain. See, e.g., US 2014/0235933, herein incorporated by reference in its entirety for all purposes.

Also provided are methods of treating a subject with X-linked juvenile retinoschisis (XLRS). Such methods can comprise administering a nucleic acid construct, vector, or lipid nanoparticle as described elsewhere herein to a subject with XLRS, wherein the nucleic acid construct is integrated into and expressed from the target genomic locus in one or more retinal cells (e.g., photoreceptors) in the subject, and a therapeutically effective level of retinoschisin expression is achieved in the subject. The subject can have, for example, an endogenous RS1 gene comprising at least one mutation associated with or that causes X-linked juvenile retinoschisis (e.g., R141C). The retinoschisin coding sequence can be operably linked to an endogenous promoter at the target genomic locus upon integration into the target genomic locus, or it can be operably linked to an exogenous promoter present in the nucleic acid construct. Such methods can also comprise administering to the subject a nucleic acid construct, vector, or lipid nanoparticle as described elsewhere herein and a nuclease agent or a nucleic acid encoding the nuclease agent, wherein the nuclease agent targets a nuclease target sequence in the target genomic locus, the nucleic acid construct is integrated into and expressed from the target genomic locus in one or more retinal cells (e.g., photoreceptors) in the subject, and a therapeutically effective level of retinoschisin expression is achieved in the subject. Such methods can also comprise administering to the subject a composition comprising a nucleic acid construct, vector, or lipid nanoparticle disclosed herein and a nuclease agent or a nucleic acid encoding the nuclease agent, wherein the nuclease agent targets a nuclease target sequence in the target genomic locus, the nucleic acid construct is integrated into and expressed from the target genomic locus in one or more retinal cells (e.g., photoreceptors) in the subject, and a therapeutically effective level of retinoschisin expression is achieved in the subject.

XLRS is a vitreo-retinal dystrophy characterized by macular pathology and by splitting of the superficial layer of the retina. Macular changes are present in almost all cases. In the fundi, radially oriented intraretinal foveomacular cysts are seen in a spoke-wheel configuration, with the absence of foveal reflex in most cases. In addition, approximately half of cases have bilateral peripheral retinoschisis in the inferotemporal part of the retina. Aside from the typical fundus appearance, strabismus, nystagmus, axial hyperopia, defective color vision and foveal ectopy can be present. The most important complications are vitreous hemorrhage, retinal detachment, and neovascular glaucoma. Foveal schisis with "spoke-wheel" pattern is the characteristic finding on fundus exam, present in nearly 100% of cases. Schisis may occur peripherally in up to 50% of patients. Peripheral schisis can lead to holes and tears of the inner leaf with potential for hemorrhage from unsupported crossing vessels. Additional peripheral changes include pigmentation resembling RP, retinal fibrosis and white flecks.

Because XLRS is a recessive disease caused by the loss in retinoschisin function, gene replacement therapy has been considered as a potential treatment for this disease. Furthermore, because retinoschisin functions as an extracellular protein, beneficial treatment is not necessarily restricted to the transfected cell expressing the replacement gene but can encompass a wider area due to the spread of the secreted protein from the site of expression.

In some methods, integration of the nucleic acid construct results in retinal structural restoration (e.g., at least partial retinal structural restoration). In some methods, integration of the nucleic acid construct results in retinal functional restoration (e.g., at least partial retinal functional restoration).

The subject with XLRS in the above methods can be any type of animal as disclosed above. In a particular example, the subject is a human.

In methods targeting a cell in vivo in an animal, the nucleic acid construct can be inserted in particular types of cells in the animal. The method and vehicle for introducing the nuclease agent (or nucleic acid encoding the nuclease agent) and the nucleic acid construct into the animal can affect which types of cells in the animal are targeted. In some methods, for example, the nucleic acid construct is inserted into a target genomic locus (e.g., an endogenous RS1 locus) in retinal cells, such as photoreceptors. Methods and vehicles for introducing the nuclease agent (or nucleic acid encoding the nuclease agent) and the nucleic acid construct into the animal (including methods and vehicles that target the eye or retinal cells (e.g., photoreceptors), such as lipid nanoparticle-mediated delivery and AAV2-mediated delivery, AAV5-mediated delivery, AAV8-mediated delivery, or AAV7m8-mediated delivery and intravitreal or subretinal injection), are disclosed in more detail elsewhere herein.

Any target genomic locus capable of expressing a gene can be used, such as a safe harbor locus (safe harbor gene) or an endogenous RS1 locus. Such loci are described in more detail elsewhere herein. In a specific example, the target genomic locus can be an endogenous RS1 locus, such as an endogenous RS1 locus comprising one or more mutations associated with or that cause XLRS (e.g., R141C). For example, the nucleic acid construct can be genomically integrated in intron 1 of the endogenous RS1 locus. Endogenous RS1 exon 1 can then splice into the coding sequence for the retinoschisin protein or fragment or variant thereof in the nucleic acid construct. In a specific example, the modified RS1 locus comprising the genomically integrated nucleic acid construct encodes a protein comprising, consisting essentially of, or consisting of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 2 or 4. In a specific example, the modified RS1 locus comprising the genomically integrated nucleic acid construct comprises an RS1 coding sequence comprising, consisting essentially of, or consisting of a sequence at least about 90%, at least about 91%, at least about 92%, at least about 93%, at least about 94%, at least about 95%, at least about 96%, at least about 97%, at least about 98%, at least about 99%, or 100% identical to SEQ ID NO: 6, 11, or 12.

Integration of the nucleic acid construct into the endogenous RS1 locus can, in some cases, prevent transcription of the endogenous RS1 gene downstream of the integration site. The integration of the nucleic acid construct into the endogenous RS1 locus can reduce or eliminate expression of the endogenous retinoschisin protein and replace it with expression of the retinoschisin protein or fragment or variant thereof encoded by the nucleic acid construct. In one example, integration of the nucleic acid construct into the endogenous RS1 locus reduces expression of the endogenous retinoschisin protein. In another example, integration of the nucleic acid construct into the endogenous RS1 locus eliminates expression of the endogenous retinoschisin protein. In methods targeting cells in vivo, such as methods of treating a subject with XLRS, the integration of the nucleic acid construct into the endogenous RS1 locus in one or more cells can reduce or eliminate expression of the endogenous retinoschisin protein in those cells and replace it with expression of the retinoschisin protein or fragment or variant thereof encoded by the nucleic acid construct. In this way, integration of the nucleic acid construct can simultaneously knock out the endogenous RS1 gene (e.g., an endogenous RS1 gene comprising one or more mutations associated with or that cause XLRS, such as R141C) and knock in a replacement retinoschisin coding sequence (e.g., a replacement retinoschisin coding sequence that does not comprise mutations associated with or that cause XLRS). In other methods, however, an endogenous RS1 gene comprising one or more mutations associated with or that cause XLRS can first be inactivated (e.g., using one or more nuclease agents that target and disrupt the endogenous RS1 gene), and a nucleic acid construct comprising a replacement retinoschisin coding sequence (e.g., a replacement retinoschisin coding sequence that does not comprise mutations associated with or that cause XLRS) can subsequently be integrated into a target genomic locus. In other methods, the nucleic acid construct can be integrated first, and the endogenous RS1 gene can subsequently be inactivated.

Targeted insertion of the nucleic acid construct comprising the retinoschisin coding sequence into a target genomic locus, and particularly an endogenous RS1 locus, offers multiple advantages. Such methods result in stable modification to allow for stable, long-term expression of the retinoschisin coding sequence. With respect to the RS1 locus, such methods are able to utilize the endogenous RS1 promoter and regulatory regions to achieve physiologically relevant expression (level of expression, timing of expression, and location of expression). For example, the retinoschisin coding sequence in the nucleic acid construct can comprise a promoterless gene, and the inserted nucleic acid construct can be operably linked to an endogenous promoter in the target genomic locus (e.g., RS1 locus). Use of an endogenous promoter is advantageous because it obviates the need for inclusion of a promoter in the nucleic acid construct, allowing packaging of larger transgenes that may not normally package efficiently (e.g., in AAV). Alternatively, the retinoschisin coding sequence in the nucleic acid construct can be operably linked to an exogenous promoter in the nucleic acid construct. Examples of types of promoters that can be used are disclosed elsewhere herein.

Optionally, some or all of the endogenous gene (e.g., endogenous RS1 gene) at the target genomic locus can be expressed upon insertion of the retinoschisin coding sequence from the nucleic acid construct. Alternatively, in some methods, none of the endogenous gene at the target genomic locus is expressed. As one example, the modified target genomic locus (e.g., modified RS1 locus) after integration of the nucleic acid construct can encode a chimeric protein comprising an endogenous secretion signal or a fragment thereof and the retinoschisin protein encoded by the nucleic acid construct. In another example, the first intron of an RS1 locus can be targeted. The secretion signal peptide of RS1 is encoded by exon 1 and part of exon 2 of the RS1 gene. In such a scenario, a promoterless cassette bearing a splice acceptor and the retinoschisin coding sequence will support expression and secretion of the retinoschisin protein. Splicing between endogenous RS1 exon 1 and the integrated retinoschisin coding sequence creates a chimeric mRNA and protein including the endogenous retinoschisin sequence encoded by exon 1 operably linked to the retinoschisin protein sequence encoded by the integrated nucleic acid construct.

The retinoschisin coding sequence in the nucleic acid construct can be inserted into the target genomic locus by any means, including homologous recombination (HR) and non-homologous end joining (NHEJ) as described elsewhere herein.

In a specific example, the nucleic acid construct can be inserted via homology-independent targeted integration (e.g., directional homology-independent targeted integration). For example, the retinoschisin coding sequence in the nucleic acid construct can be flanked on each side by a target site for a nuclease agent (e.g., the same target site as in the target genomic locus, and the same nuclease agent being used to cleave the target site in the target genomic locus). The nuclease agent can then cleave the target sites flanking the retinoschisin coding sequence. In a specific example, the nucleic acid construct is delivered AAV-mediated delivery, and cleavage of the target sites flanking the retinoschisin coding sequence can remove the inverted terminal repeats (ITRs) of the AAV. Removal of the ITRs can make it easier to assess successful targeting, because presence of the ITRs can hamper sequencing efforts due to the repeated sequences. In some methods, the target site in the target genomic locus (e.g., a gRNA target sequence including the flanking protospacer adjacent motif) is no longer present if the retinoschisin coding sequence is inserted into the target genomic locus in the correct orientation but it is reformed if the retinoschisin protein coding sequence is inserted into the target genomic locus in the opposite orientation. This can help ensure that the retinoschisin coding sequence is inserted in the correct orientation for expression.

In methods in which a nucleic acid construct (or vector or LNP) and a nuclease agent or nucleic acid encoding a nuclease agent are administered together with a nucleic acid construct, the nucleic acid construct and the nuclease agent or the nucleic acid encoding the nuclease agent can be administered simultaneously. Alternatively, the nucleic acid construct and the nuclease agent or the nucleic acid encoding the nuclease agent can be administered sequentially in any order. For example, the nucleic acid construct can be administered after the nuclease agent or the nucleic acid encoding the nuclease agent, or the nuclease agent or the nucleic acid encoding the nuclease agent can be administered after the nucleic acid construct. For example, the nuclease agent or the nucleic acid encoding the nuclease agent can be administered about 1 hour to about 48 hours, about 1 hour to about 24 hours, about 1 hour to about 12 hours, about 1 hour to about 6 hours, about 1 hour to about 2 hours, about 2 hours to about 48 hours, about 2 hours to about 24 hours, about 2 hours to about 12 hours, about 2 hours to about 6 hours, about 3 hours to about 48 hours, about 6 hours to about 48 hours, about 12 hours to about 48 hours, or about 24 hours to about 48 hours prior to or subsequent to administration of the nucleic acid construct.

The nucleic acid construct and the nuclease agent or nucleic acid encoding a nuclease agent can be administered in any suitable delivery vehicle. In some methods, the nucleic acid construct and the nuclease agent or nucleic acid encoding a nuclease agent can be administered in the same delivery vehicle (e.g., the same lipid nanoparticle or vector). In some methods in which the nuclease agent comprises a Cas protein or a nucleic acid encoding a Cas protein and a guide RNA or a DNA encoding a guide RNA, both components can be administered in the same delivery vehicle, or alternatively they can be delivered in separate delivery vehicles. In other methods, the nucleic acid construct and the nuclease agent or nucleic acid encoding a nuclease agent can be administered in different delivery vehicles (e.g., administration of the nuclease agent or the nucleic acid encoding the nuclease agent in a first vector or in an LNP, and administration of the nucleic acid construct in a second vector, such as an AAV vector).

The nuclease agent (or nucleic acid encoding the nuclease agent) and the nucleic acid construct can be introduced in any form (e.g., DNA or RNA for guide RNAs; DNA, RNA, or protein for Cas proteins) via any delivery method (e.g., AAV, LNP, or HDD) and any route of administration (e.g., intravitreal injection or subretinal injection) as disclosed elsewhere herein. As one example, the nucleic acid construct is delivered via adeno-associated virus (AAV)-mediated delivery (e.g., AAV2-mediated delivery, AAV5-mediated delivery, AAV8-mediated delivery, or AAV7m8-mediated delivery). Likewise, the nuclease agent (or nucleic acid encoding the nuclease agent) can be delivered by lipid nanoparticle (LNP)-mediated delivery or AAV-mediated delivery. For example, the nuclease agent can be CRISPR/Cas9, and a Cas9 mRNA and a gRNA targeting an endogenous RS1 locus (e.g., intron 1 of RS1) can be delivered via LNP-mediated delivery or AAV-mediated delivery, and the nucleic acid construct (e.g., a bidirectional construct or a homology-independent targeted integration construct) can be delivered via AAV2-mediated delivery, AAV5-mediated delivery, AAV8-mediated delivery, or AAV7m8-mediated delivery. In another specific example, both the nucleic acid encoding the nuclease agent and the nucleic acid construct are delivered via AAV-mediated delivery (e.g., in a single AAV or via two separate AAVs). For example, a first AAV can carry a Cas9 expression cassette, and a second AAV can carry a gRNA expression cassette and the nucleic acid construct. Similarly, a first AAV can carry a Cas9 expression cassette, and a second AAV can carry two or more gRNA expression cassettes and the nucleic acid construct. Alternatively, a first AAV can carry a Cas9 expression cassette (e.g., Cas9 coding sequence operably linked to a promoter) and a gRNA expression cassette (e.g., gRNA coding sequence operably linked to a promoter), and the second AAV can carry the nucleic acid construct. Similarly, a first AAV can carry a Cas9 expression cassette (e.g., Cas9 coding sequence operably linked to a promoter) and two gRNA expression cassettes (e.g., gRNA coding sequences operably linked to promoters), and the second AAV can carry the nucleic acid construct. Different promoters can be used to drive expression of the gRNA, such as a U6 promoter or the small tRNA Gln. Likewise, different promoters can be used to drive Cas9 expression. In some methods, small promoters are used so that the Cas9 coding sequence can fit into an AAV construct. In some methods, small Cas9 proteins (e.g., SaCas9 or CjCas9 are used to maximize the AAV packaging capacity).

The methods disclosed herein comprise administering or introducing into a cell or animal nuclease agents (or nucleic acids encoding nuclease agents) and nucleic acid constructs (i.e., exogenous donor nucleic acids) comprising a retinoschisin coding sequence (i.e., encoding a retinoschisin protein or fragment or variant thereof) for integration into and expression from a target genomic locus. "Introducing" includes presenting to the cell or animal the nucleic acid or protein in such a manner that the nucleic acid or protein gains access to the interior of the cell or to the interior of cells within the animal. The introducing can be accomplished by any means, and two or more of the components (e.g., two of the components, or all of the components) can be introduced into the cell or animal simultaneously or sequentially in any combination. For example, a nuclease agent can be introduced into a cell or animal before introduction of the nucleic acid construct. In addition, two or more of the components can be introduced into the cell or animal by the same delivery method or different delivery methods. Similarly, two or more of the components can be introduced into an animal by the same route of administration or different routes of administration.

A guide RNA can be introduced into the cell in the form of an RNA (e.g., in vitro transcribed RNA) or in the form of a DNA encoding the guide RNA. Likewise, protein components such as Cas9 proteins, ZFNs, or TALENs can be introduced into the cell in the form of DNA, RNA, or protein. For example, a guide RNA and a Cas9 protein can both be introduced in the form of RNA. When introduced in the form of a DNA, the DNA encoding a guide RNA can be operably linked to a promoter active in the cell. For example, a guide RNA may be delivered via AAV and expressed in vivo under a U6 promoter. Such DNAs can be in one or more expression constructs. For example, such expression constructs can be components of a single nucleic acid molecule. Alternatively, they can be separated in any combination among two or more nucleic acid molecules (i.e., DNAs encoding one or more CRISPR RNAs and DNAs encoding one or more tracrRNAs can be components of a separate nucleic acid molecules).

Nucleic acids encoding guide RNAs or nuclease agents can be operably linked to a promoter in an expression construct. Expression constructs include any nucleic acid constructs capable of directing expression of a gene or other nucleic acid sequence of interest and which can transfer such a nucleic acid sequence of interest to a target cell. Suitable promoters that can be used in an expression construct include promoters active, for example, in one or more of a eukaryotic cell, a human cell, a non-human cell, a mammalian cell, a non-human mammalian cell, a rodent cell, a mouse cell, a rat cell, a hamster cell, a rabbit cell, a pluripotent cell, an embryonic stem (ES) cell, an adult stem cell, a developmentally restricted progenitor cell, an induced pluripotent stem (iPS) cell, or a one-cell stage embryo. Such promoters can be, for example, conditional promoters, inducible promoters, constitutive promoters, or tissue-specific promoters. Optionally, the promoter can be a bidirectional promoter driving expression of both a guide RNA in one direction and another component in the other direction. Such bidirectional promoters can consist of (1) a complete, conventional, unidirectional Pol III promoter that contains 3 external control elements: a distal sequence element (DSE), a proximal sequence element (PSE), and a TATA box; and (2) a second basic Pol III promoter that includes a PSE and a TATA box fused to the 5' terminus of the DSE in reverse orientation. For example, in the H1 promoter, the DSE is adjacent to the PSE and the TATA box, and the promoter can be rendered bidirectional by creating a hybrid promoter in which transcription in the reverse direction is controlled by appending a PSE and TATA box derived from the U6 promoter. See, e.g., US 2016/0074535, herein incorporated by references in its entirety for all purposes. Use of a bidirectional promoter to express genes encoding a guide RNA and another component simultaneously allows for the generation of compact expression cassettes to facilitate delivery.

Guide RNAs or nucleic acids encoding guide RNAs (or other components) can be provided in compositions comprising a carrier increasing the stability of the guide RNA (e.g., prolonging the period under given conditions of storage (e.g., $-20°$ C., $4°$ C., or ambient temperature) for which degradation products remain below a threshold, such below 0.5% by weight of the starting nucleic acid or protein; or increasing the stability in vivo). Non-limiting examples of such carriers include poly(lactic acid) (PLA) microspheres, poly(D,L-lactic-coglycolic-acid) (PLGA) microspheres, liposomes, micelles, inverse micelles, lipid cochleates, and lipid microtubules.

The methods provided herein do not depend on a particular method for introducing a nucleic acid or protein into the cell, only that the nucleic acid or protein gains access to the interior of a least one cell. Methods for introducing nucleic acids and proteins into various cell types are known in the art and include, for example, stable transfection methods, transient transfection methods, and virus-mediated methods.

Transfection protocols as well as protocols for introducing nucleic acids or proteins into cells may vary. Non-limiting transfection methods include chemical-based transfection methods using liposomes; nanoparticles; calcium phosphate (Graham et al. (1973) *Virology* 52 (2): 456-67, Bacchetti et al. (1977) *Proc. Natl. Acad. Sci. USA* 74 (4): 1590-4, and Kriegler, M (1991). Transfer and Expression: A Laboratory Manual. New York: W. H. Freeman and Company. pp. 96-97); dendrimers; or cationic polymers such as DEAE-dextran or polyethylenimine. Non-chemical methods include electroporation, sonoporation, and optical transfection. Particle-based transfection includes the use of a gene gun, or magnet-assisted transfection (Bertram (2006) *Current Pharmaceutical Biotechnology* 7, 277-28). Viral methods can also be used for transfection.

Introduction of nucleic acids or proteins into a cell can also be mediated by electroporation, by intracytoplasmic injection, by viral infection, by adenovirus, by lentivirus, by retrovirus, by transfection, by lipid-mediated transfection, or by nucleofection. Introduction of nucleic acids or proteins into a cell can also be mediated by adeno-associated virus. Nucleofection is an improved electroporation technology that enables nucleic acid substrates to be delivered not only to the cytoplasm but also through the nuclear membrane and into the nucleus. In addition, use of nucleofection in the methods disclosed herein typically requires much fewer cells than regular electroporation (e.g., only about 2 million compared with 7 million by regular electroporation). In one example, nucleofection is performed using the LONZA® NUCLEOFECTOR™ system.

Introduction of nucleic acids or proteins into a cell (e.g., a one-cell stage embryo) can also be accomplished by microinjection. In one-cell stage embryos, microinjection can be into the maternal and/or paternal pronucleus or into the cytoplasm. If the microinjection is into only one pronucleus, the paternal pronucleus is preferable due to its larger size. Microinjection of an mRNA is preferably into the cytoplasm (e.g., to deliver mRNA directly to the translation machinery), while microinjection of a Cas protein or a nucleic acid encoding a Cas protein or encoding an RNA is preferable into the nucleus/pronucleus. Alternatively, microinjection can be carried out by injection into both the nucleus/pronucleus and the cytoplasm: a needle can first be introduced into the nucleus/pronucleus and a first amount can be injected, and while removing the needle from the one-cell stage embryo a second amount can be injected into the cytoplasm. If a Cas protein is injected into the cytoplasm, the Cas protein preferably comprises a nuclear localization signal to ensure delivery to the nucleus/pronucleus. Methods for carrying out microinjection are well known. See, e.g., Nagy et al. (Nagy A, Gertsenstein M, Vintersten K, Behringer R., 2003, Manipulating the Mouse Embryo. Cold Spring Harbor, New York: Cold Spring Harbor Laboratory Press); Meyer et al. (2010) *Proc. Natl. Acad. Sci. USA* 107:15022-15026 and Meyer et al. (2012) *Proc. Natl. Acad. Sci. USA* 109:9354-9359. Introduction into one-cell stage embryos can also be accomplished by electroporation.

Various methods and compositions are provided herein to allow for introduction of a nucleic acid or protein into a cell or animal. Such methods for introducing nucleic acid or proteins into a cell or animal can include, for example, vector delivery, particle-mediated delivery, exosome-mediated delivery, lipid-nanoparticle (LNP)-mediated delivery, cell-penetrating-peptide-mediated delivery, or implantable-device-mediated delivery. As specific examples, a nucleic acid or protein can be introduced into a cell or animal in a carrier such as a poly(lactic acid) (PLA) microsphere, a poly(D,L-lactic-coglycolic-acid) (PLGA) microsphere, a liposome, a micelle, an inverse micelle, a lipid cochleate, or a lipid microtubule. Some specific examples of delivery to an animal include hydrodynamic delivery, virus-mediated delivery (e.g., adeno-associated virus (AAV)-mediated delivery, or by adenovirus, by lentivirus, or by retrovirus), and lipid-nanoparticle-mediated delivery. In one specific example, both the nuclease agent and nucleic acid construct can be delivered via LNP-mediated delivery. In another specific example, both the nuclease agent and nucleic acid construct can be delivered via AAV-mediated delivery. For example, the nuclease agent and the nucleic acid construct can be delivered via multiple different AAV vectors (e.g., two different AAV vectors). In a specific example in which the nuclease agent is CRISPR/Cas (e.g., CRISPR/Cas9), a first AAV vector can deliver the Cas (e.g., Cas9), and a second AAV vector can deliver the gRNA and the nucleic acid construct. For example, small promoters can be used so that the Cas9 coding sequence can fit into an AAV construct.

In another specific example, the nuclease agent can be delivered via LNP-mediated delivery and the nucleic acid construct can be delivered via AAV-mediated delivery. In another specific example, the nuclease agent can be delivered via AAV-mediated delivery and the nucleic acid construct can be delivered via LNP-mediated delivery.

Introduction of nucleic acids can also be accomplished by virus-mediated delivery, such as AAV-mediated delivery or lentivirus-mediated delivery (e.g., an AAV vector or a lentiviral vector). Other exemplary viruses/viral vectors include retroviruses, adenoviruses, vaccinia viruses, poxviruses, and herpes simplex viruses. The viruses can infect dividing cells, non-dividing cells, or both dividing and non-dividing cells. The viruses can integrate into the host genome or alternatively do not integrate into the host genome. Such viruses can also be engineered to have reduced immunity. The viruses can be replication-competent or can be replication-defective (e.g., defective in one or more genes necessary for additional rounds of virion replication and/or packaging). Viruses can cause transient expression, long-lasting expression (e.g., at least 1 week, 2 weeks, 1 month, 2 months, or 3 months), or permanent expression (e.g., of Cas9 and/or gRNA). Exemplary viral titers (e.g., AAV titers) include $10^{12}$, $10^{13}$, $10^{14}$, $10^{15}$, and $10^{16}$ vector genomes/mL. Exemplary viral titers (e.g., AAV titers) include about $10^{12}$, about $10^{13}$, about $10^{14}$, about $10^{15}$, and about $10^{16}$ vector genomes (vg)/mL, or between about $10^{12}$ to about $10^{16}$, between about $10^{12}$ to about $10^{15}$, between about $10^{12}$ to about $10^{14}$, between about $10^{12}$ to about 101, between about $10^{13}$ to about $10^{16}$, between about $10^{14}$ to about $10^{16}$, between about $10^{15}$ to about $10^{16}$, or between about $10^{13}$ to about $10^{15}$ vg/mL. Other exemplary viral titers (e.g., AAV titers) include about $10^{12}$, about $10^{13}$, about $10^{14}$, about $10^{15}$, and about $10^{16}$ vector genomes (vg)/kg of body weight, or between about $10^{12}$ to about $10^{16}$, between about $10^{12}$ to about $10^{15}$, between about $10^{12}$ to about $10^{14}$, between about $10^{12}$ to about $10^{13}$, between about 101 to about $10^{16}$, between about $10^{14}$ to about $10^{16}$, between about $10^{15}$ to about $10^{16}$, or between about $10^{13}$ to about $10^{15}$ vg/kg of body weight.

The ssDNA AAV genome consists of two open reading frames, Rep and Cap, flanked by two inverted terminal repeats that allow for synthesis of the complementary DNA strand. When constructing an AAV transfer plasmid, the transgene is placed between the two ITRs, and Rep and Cap can be supplied in trans. In addition to Rep and Cap, AAV can require a helper plasmid containing genes from adenovirus. These genes (E4, E2a, and VA) mediate AAV replication. For example, the transfer plasmid, Rep/Cap, and the helper plasmid can be transfected into HEK293 cells containing the adenovirus gene E1+ to produce infectious AAV particles. Alternatively, the Rep, Cap, and adenovirus helper genes may be combined into a single plasmid. Similar packaging cells and methods can be used for other viruses, such as retroviruses.

Multiple serotypes of AAV have been identified. These serotypes differ in the types of cells they infect (i.e., their tropism), allowing preferential transduction of specific cell types. Serotypes for photoreceptor cells include AAV2, AAV5, and AAV8. Serotypes for retinal pigment epithelium tissue include AAV1, AAV2, AAV4, AAV5, and AAV8. In a specific example, the AAV vector comprising the nucleic acid construct can be AAV2, AAV5, or AAV8.

Tropism can be further refined through pseudotyping, which is the mixing of a capsid and a genome from different viral serotypes. For example AAV2/5 indicates a virus containing the genome of serotype 2 packaged in the capsid from serotype 5. Use of pseudotyped viruses can improve transduction efficiency, as well as alter tropism. Hybrid capsids derived from different serotypes can also be used to alter viral tropism. For example, AAV-DJ contains a hybrid capsid from eight serotypes and displays high infectivity across a broad range of cell types in vivo. AAV-DJ8 is another example that displays the properties of AAV-DJ but with enhanced brain uptake. AAV serotypes can also be modified through mutations. Examples of mutational modifications of AAV2 include Y444F, Y500F, Y730F, and S662V. Examples of mutational modifications of AAV3 include Y705F, Y731F, and T492V. Examples of mutational modifications of AAV6 include S663V and T492V. Other pseudotyped/modified AAV variants include AAV2/1, AAV2/6, AAV2/7, AAV2/8, AAV2/9, AAV2.5, AAV8.2, and AAV/SASTG. In a specific example, the AAV is AAV7m8, an AAV variant that mediates highly efficient delivery to all retinal layers and to photoreceptors. See, e.g., Dalkara et al. (2013) *Sci. Transt. Med.* 5:189ra76, herein incorporated by reference in its entirety for all purposes.

To accelerate transgene expression, self-complementary AAV (scAAV) variants can be used. Because AAV depends on the cell's DNA replication machinery to synthesize the complementary strand of the AAV's single-stranded DNA genome, transgene expression may be delayed. To address this delay, scAAV containing complementary sequences that are capable of spontaneously annealing upon infection can be used, eliminating the requirement for host cell DNA synthesis. However, single-stranded AAV (ssAAV) vectors can also be used.

To increase packaging capacity, longer transgenes may be split between two AAV transfer plasmids, the first with a 3' splice donor and the second with a 5' splice acceptor. Upon co-infection of a cell, these viruses form concatemers, are spliced together, and the full-length transgene can be expressed. Although this allows for longer transgene expression, expression is less efficient. Similar methods for increasing capacity utilize homologous recombination. For example, a transgene can be divided between two transfer plasmids but with substantial sequence overlap such that co-expression induces homologous recombination and expression of the full-length transgene.

In certain AAVs, the cargo can include a nuclease agent (i.e., nucleic acid encoding a nuclease agent). In certain AAVs, the cargo can include a guide RNA or a nucleic acid encoding a guide RNA. In certain AAVs, the cargo can include an mRNA encoding a Cas nuclease, such as Cas9, and a guide RNA or a nucleic acid encoding a guide RNA. In certain AAVs, the cargo can include a nucleic acid construct as described elsewhere herein. In certain AAVs, the cargo can include a nuclease agent and a nucleic acid construct as described elsewhere herein. In certain AAVs, the cargo can include an mRNA encoding a Cas nuclease, such as Cas9, a guide RNA or a nucleic acid encoding a guide RNA, and a nucleic acid construct as described elsewhere herein.

Introduction of nucleic acids and proteins can also be accomplished by lipid nanoparticle (LNP)-mediated delivery. For example, LNP-mediated delivery can be used to deliver a guide RNA in the form of RNA. Delivery through such methods results in transient presence of the guide RNA, and the biodegradable lipids improve clearance, improve tolerability, and decrease immunogenicity. Lipid formulations can protect biological molecules from degradation while improving their cellular uptake. Lipid nanoparticles are particles comprising a plurality of lipid molecules physically associated with each other by intermolecular forces. These include microspheres (including unilamellar and multilamellar vesicles, e.g., liposomes), a dispersed phase in an emulsion, micelles, or an internal phase in a suspension. Such lipid nanoparticles can be used to encapsulate one or more nucleic acids or proteins for delivery. Formulations which contain cationic lipids are useful for delivering polyanions such as nucleic acids. Other lipids that can be included are neutral lipids (i.e., uncharged or zwitterionic lipids), anionic lipids, helper lipids that enhance transfection, and stealth lipids that increase the length of time for which nanoparticles can exist in vivo. Examples of suitable cationic lipids, neutral lipids, anionic lipids, helper lipids, and stealth lipids can be found in WO 2016/010840 A1 and WO 2017/173054 A1, each of which is herein incorporated by reference in its entirety for all purposes. An exemplary lipid nanoparticle can comprise a cationic lipid and one or more other components. In one example, the other component can comprise a helper lipid such as cholesterol. In another example, the other components can comprise a helper lipid such as cholesterol and a neutral lipid such as DSPC. In another example, the other components can comprise a helper lipid such as cholesterol, an optional neutral lipid such as DSPC, and a stealth lipid such as S010, S024, S027, S031, or S033.

The LNP may contain one or more or all of the following: (i) a lipid for encapsulation and for endosomal escape; (ii) a neutral lipid for stabilization; (iii) a helper lipid for stabilization; and (iv) a stealth lipid. See, e.g., Finn et al. (2018) *Cell Rep.* 22(9):2227-2235 and WO 2017/173054 A1, each of which is herein incorporated by reference in its entirety for all purposes. In certain LNPs, the cargo can include a nuclease agent. In certain LNPs, the cargo can include a guide RNA or a nucleic acid encoding a guide RNA. In certain LNPs, the cargo can include an mRNA encoding a Cas nuclease, such as Cas9, and a guide RNA or a nucleic acid encoding a guide RNA. In certain LNPs, the cargo can include an exogenous donor sequence. In certain LNPs, the cargo can include a nuclease agent and an exogenous donor sequence. In certain LNPs, the cargo can include an mRNA encoding a Cas nuclease, such as Cas9, a guide RNA or a nucleic acid encoding a guide RNA, and an exogenous donor sequence.

The lipid for encapsulation and endosomal escape can be a cationic lipid. The lipid can also be a biodegradable lipid, such as a biodegradable ionizable lipid. One example of a suitable lipid is Lipid A or LP01, which is (9Z,12Z)-3-((4, 4-bis(octyloxy)butanoyl)oxy)-2-((((3-(diethylamino) propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z, 12Z)-octadeca-9,12-dienoate. See, e.g., Finn et al. (2018) *Cell Rep.* 22(9):2227-2235 and WO 2017/173054 A1, each of which is herein incorporated by reference in its entirety for all purposes. Another example of a suitable lipid is Lipid B, which is ((5-((dimethylamino)methyl)-1,3-phenylene)bis (oxy))bis(octane-8,1-diyl)bis(decanoate), also called ((5-((dimethylamino)methyl)-1,3-phenylene)bis(oxy))bis(octane-8,1-diyl)bis(decanoate). Another example of a suitable lipid is Lipid C, which is 2-((4-(((3-(dimethylamino) propoxy)carbonyl)oxy)hexadecanoyl)oxy)propane-1,3-diyl (9Z,9'Z,12Z,12'Z)-bis(octadeca-9,12-dienoate). Another example of a suitable lipid is Lipid D, which is 3-(((3-(dimethylamino)propoxy)carbonyl)oxy)-13-(octanoyloxy) tridecyl 3-octylundecanoate. Other suitable lipids include heptatriaconta-6,9,28,31-tetraen-19-yl 4-(dimethylamino) butanoate (also known as Dlin-MC3-DMA (MC3))).

Some such lipids suitable for use in the LNPs described herein are biodegradable in vivo. For example, LNPs comprising such a lipid include those where at least 75% of the lipid is cleared from the plasma within 8, 10, 12, 24, or 48 hours, or 3, 4, 5, 6, 7, or 10 days. As another example, at least 50% of the LNP is cleared from the plasma within 8, 10, 12, 24, or 48 hours, or 3, 4, 5, 6, 7, or 10 days.

Such lipids may be ionizable depending upon the pH of the medium they are in. For example, in a slightly acidic medium, the lipids may be protonated and thus bear a positive charge. Conversely, in a slightly basic medium, such as, for example, blood where pH is approximately 7.35, the lipids may not be protonated and thus bear no charge. In some embodiments, the lipids may be protonated at a pH of at least about 9, 9.5, or 10. The ability of such a lipid to bear a charge is related to its intrinsic pKa. For example, the lipid may, independently, have a pKa in the range of from about 5.8 to about 6.2.

Neutral lipids function to stabilize and improve processing of the LNPs. Examples of suitable neutral lipids include a variety of neutral, uncharged or zwitterionic lipids. Examples of neutral phospholipids suitable for use in the present disclosure include, but are not limited to, 5-heptadecylbenzene-1,3-diol (resorcinol), dipalmitoylphosphatidylcholine (DPPC), distearoylphosphatidylcholine (DSPC), phosphocholine (DOPC), dimyristoylphosphatidylcholine (DMPC), phosphatidylcholine (PLPC), 1,2-distearoyl-sn-glycero-3-phosphocholine (DAPC), phosphatidylethanolamine (PE), egg phosphatidylcholine (EPC), dilauryloylphosphatidylcholine (DLPC), dimyristoylphosphatidylcholine (DMPC), 1-myristoyl-2-palmitoyl phosphatidylcholine (MPPC), 1-palmitoyl-2-myristoyl phosphatidylcholine (PMPC), 1-palmitoyl-2-stearoyl phosphatidylcholine (PSPC), 1,2-diarachidoyl-sn-glycero-3-phosphocholine (DBPC), 1-stearoyl-2-palmitoyl phosphatidylcholine (SPPC), 1,2-dieicosenoyl-sn-glycero-3-phosphocholine (DEPC), palmitoyloleoyl phosphatidylcholine (POPC), lysophosphatidyl choline, dioleoyl phosphatidylethanolamine (DOPE), dilinoleoylphosphatidylcholine distearoylphosphatidylethanolamine (DSPE), dimyristoyl phosphatidylethanolamine (DMPE), dipalmitoyl phosphatidylethanolamine (DPPE), palmitoyloleoyl phosphatidylethanolamine (POPE), lyso-phosphatidylethanolamine, and combinations thereof. For example, the neutral phospholipid may be selected from the group consisting of distearoylphosphatidylcholine (DSPC) and dimyristoyl phosphatidyl ethanolamine (DMPE).

Helper lipids include lipids that enhance transfection. The mechanism by which the helper lipid enhances transfection can include enhancing particle stability. In certain cases, the helper lipid can enhance membrane fusogenicity. Helper lipids include steroids, sterols, and alkyl resorcinols. Examples of suitable helper lipids suitable include cholesterol, 5-heptadecylresorcinol, and cholesterol hemisuccinate. In one example, the helper lipid may be cholesterol or cholesterol hemisuccinate.

Stealth lipids include lipids that alter the length of time the nanoparticles can exist in vivo. Stealth lipids may assist in the formulation process by, for example, reducing particle aggregation and controlling particle size. Stealth lipids may modulate pharmacokinetic properties of the LNP. Suitable stealth lipids include lipids having a hydrophilic head group linked to a lipid moiety.

The hydrophilic head group of stealth lipid can comprise, for example, a polymer moiety selected from polymers based on PEG (sometimes referred to as poly(ethylene oxide)), poly(oxazoline), poly(vinyl alcohol), poly(glycerol), poly(N-vinylpyrrolidone), polyaminoacids, and poly N-(2-hydroxypropyl)methacrylamide. The term PEG means any polyethylene glycol or other polyalkylene ether polymer. In certain LNP formulations, the PEG, is a PEG-2K, also termed PEG 2000, which has an average molecular weight of about 2,000 daltons. See, e.g., WO 2017/173054 A1, herein incorporated by reference in its entirety for all purposes.

The lipid moiety of the stealth lipid may be derived, for example, from diacylglycerol or diacylglycamide, including those comprising a dialkylglycerol or dialkylglycamide group having alkyl chain length independently comprising from about C4 to about C40 saturated or unsaturated carbon atoms, wherein the chain may comprise one or more functional groups such as, for example, an amide or ester. The dialkylglycerol or dialkylglycamide group can further comprise one or more substituted alkyl groups.

As one example, the stealth lipid may be selected from PEG-dilauroylglycerol, PEG-dimyristoylglycerol (PEG-DMG), PEG-dipalmitoylglycerol, PEG-distearoylglycerol (PEG-DSPE), PEG-dilaurylglycamide, PEG-dimyristylglycamide, PEG-dipalmitoylglycamide, and PEG-distearoylglycamide, PEG-cholesterol (1-[8'-(Cholest-5-en-3 [beta]-oxy)carboxamido-3',6'-dioxaoctanyl]carbamoyl-[omega]-methyl-poly(ethylene glycol), PEG-DMB (3,4-ditetradecoxylbenzyl-[omega]-methyl-poly(ethylene glycol)ether), 1,2-dimyristoyl-sn-glycero-3-phosphoethanolamine-N-[methoxy(polyethylene glycol)-2000](PEG2k-DMG), 1,2-distearoyl-sn-glycero-3-phosphoethanolamine-N-[methoxy(polyethylene glycol)-2000](PEG2k-DSPE), 1,2-distearoyl-sn-glycerol, methoxypoly ethylene glycol (PEG2k-DSG), poly(ethylene glycol)-2000-dimethacrylate (PEG2k-DMA), and 1,2-distearyloxypropyl-3-amine-N-[methoxy(polyethylene glycol)-2000](PEG2k-DSA). In one particular example, the stealth lipid may be PEG2k-DMG.

The LNPs can comprise different respective molar ratios of the component lipids in the formulation. The mol-% of the CCD lipid may be, for example, from about 30 mol-% to about 60 mol-%, from about 35 mol-% to about 55 mol-%, from about 40 mol-% to about 50 mol-%, from about 42 mol-% to about 47 mol-%, or about 45%. The mol-% of the helper lipid may be, for example, from about 30 mol-% to about 60 mol-%, from about 35 mol-% to about 55 mol-%, from about 40 mol-% to about 50 mol-%, from about 41 mol-% to about 46 mol-%, or about 44 mol-%. The mol-% of the neutral lipid may be, for example, from about 1 mol-% to about 20 mol-%, from about 5 mol-% to about 15 mol-%, from about 7 mol-% to about 12 mol-%, or about 9 mol-%. The mol-% of the stealth lipid may be, for example, from about 1 mol-% to about 10 mol-%, from about 1 mol-% to about 5 mol-%, from about 1 mol-% to about 3 mol-%, about 2 mol %, or about 1 mol-%.

The LNPs can have different ratios between the positively charged amine groups of the biodegradable lipid (N) and the negatively charged phosphate groups (P) of the nucleic acid to be encapsulated. This may be mathematically represented by the equation N/P. For example, the N/P ratio may be from about 0.5 to about 100, from about 1 to about 50, from about 1 to about 25, from about 1 to about 10, from about 1 to about 7, from about 3 to about 5, from about 4 to about 5, about 4, about 4.5, or about 5.

In some LNPs, the cargo can comprise Cas mRNA and gRNA. The Cas mRNA and gRNAs can be in different ratios. For example, the LNP formulation can include a ratio of Cas mRNA to gRNA nucleic acid ranging from about 25:1 to about 1:25, ranging from about 10:1 to about 1:10, ranging from about 5:1 to about 1:5, or about 1:1. Alternatively, the LNP formulation can include a ratio of Cas mRNA to gRNA nucleic acid from about 1:1 to about 1:5, or about 10:1. Alternatively, the LNP formulation can include a ratio of Cas mRNA to gRNA nucleic acid of about 1:10, 25:1, 10:1, 5:1, 3:1, 1:1, 1:3, 1:5, 1:10, or 1:25. Alternatively, the LNP formulation can include a ratio of Cas mRNA to gRNA nucleic acid of from about 1:1 to about 1:2. In specific examples, the ratio of Cas mRNA to gRNA can be about 1:1 or about 1:2.

Exemplary dosing of LNPs includes about 0.1, about 0.25, about 0.3, about 0.5, about 1, about 2, about 3, about 4, about 5, about 6, about 8, or about 10 mg/kg body weight (mpk) or about 0.1 to about 10, about 0.25 to about 10, about 0.3 to about 10, about 0.5 to about 10, about 1 to about 10, about 2 to about 10, about 3 to about 10, about 4 to about 10, about 5 to about 10, about 6 to about 10, about 8 to about 10, about 0.1 to about 8, about 0.1 to about 6, about 0.1 to about 5, about 0.1 to about 4, about 0.1 to about 3, about 0.1 to about 2, about 0.1 to about 1, about 0.1 to about 0.5, about 0.1 to about 0.3, about 0.1 to about 0.25, about 0.25 to about 8, about 0.3 to about 6, about 0.5 to about 5, about 1 to about 5, or about 2 to about 3 mg/kg body weight with respect to total RNA (Cas9 mRNA and gRNA) cargo content. Such LNPs can be administered, for example, intravenously. In one example, LNP doses between about 0.01 mg/kg and about 10 mg/kg, between about 0.1 and about 10 mg/kg, or between about 0.01 and about 0.3 mg/kg can be used. For example, LNP doses of about 0.01, about 0.03, about 0.1, about 0.3, about 1, about 3, or about 10 mg/kg can be used. Additional exemplary dosing of LNPs includes about 0.1, about 0.25, about 0.3, about 0.5, about 1, about 2, about 3, about 4, about 5, about 6, about 8, or about 10 mg/kg (mpk) body weight or about 0.1 to about 10, about 0.25 to about 10, about 0.3 to about 10, about 0.5 to about 10, about 1 to about 10, about 2 to about 10, about 3 to about 10, about 4 to about 10, about 5 to about 10, about 6 to about 10, about 8 to about 10, about 0.1 to about 8, about 0.1 to about 6, about 0.1 to about 5, about 0.1 to about 4, about 0.1 to about 3, about 0.1 to about 2, about 0.1 to about 1, about 0.1 to about 0.5, about 0.1 to about 0.3, about 0.1 to about 0.25, about 0.25 to about 8, about 0.3 to about 6, about 0.5 to about 5, about 1 to about 5, or about 2 to about 3 mg/kg body weight with respect to total RNA (Cas9 mRNA and gRNA) cargo content. Such LNPs can be administered, for example, intravenously. In one example, LNP doses between about 0.01 mg/kg and about 10 mg/kg, between about 0.1 and about 10 mg/kg, or between about 0.01 and about 0.3 mg/kg can be used. For example, LNP doses of about 0.01, about 0.03, about 0.1, about 0.3, about 0.5, about 1, about 2, about 3, or about 10 mg/kg can be used. In another example, LNP doses between about 0.5 and about 10, between about 0.5 and about 5, between about 0.5 and about 3, between about 1 and about 10, between about 1 and about 5, between about 1 and about 3, or between about 1 and about 2 mg/kg can be used.

The mode of delivery can be selected to decrease immunogenicity. For example, different components may be delivered by different modes (e.g., bi-modal delivery). These different modes may confer different pharmacodynamics or pharmacokinetic properties on the subject delivered molecule. For example, the different modes can result in different tissue distribution, different half-life, or different temporal distribution. Some modes of delivery (e.g., delivery of a nucleic acid vector that persists in a cell by autonomous replication or genomic integration) result in more persistent expression and presence of the molecule, whereas other modes of delivery are transient and less persistent (e.g., delivery of an RNA or a protein). Delivery of components in a more transient manner, for example as RNA, can ensure that the Cas/gRNA complex is only present and active for a short period of time and can reduce immunogenicity. Such transient delivery can also reduce the possibility of off-target modifications.

Administration in vivo can be by any suitable route including, for example, via intravitreal injection or subretinal injection. Significantly smaller amounts of the components (compared with systemic approaches) may exert an effect when administered locally (for example, subretinal or intravitreal) compared to when administered systemically (for example, intravenously). Local modes of administration may also reduce or eliminate the incidence of potentially toxic side effects that may occur when therapeutically effective amounts of a component are administered systemically.

Compositions comprising the nuclease agents (e.g., Cas9 mRNAs and guide RNAs or nucleic acids encoding the guide RNAs) and/or nucleic acid constructs disclosed herein can be formulated using one or more physiologically and pharmaceutically acceptable carriers, diluents, excipients or auxiliaries. The formulation can depend on the route of administration chosen. The term "pharmaceutically acceptable" means that the carrier, diluent, excipient, or auxiliary is compatible with the other ingredients of the formulation and not substantially deleterious to the recipient thereof.

The frequency of administration and the number of dosages can depend on the half-life of the nucleic acid constructs or nuclease agents (or nucleic acids encoding the nuclease agents) and the route of administration among other factors. The introduction of nucleic acids or proteins into the cell or animal can be performed one time or multiple times over a period of time. For example, the introduction can be performed only once over a period of time, at least two times over a period of time, at least three times over a period of time, at least four times over a period of time, at least five times over a period of time, at least six times over a period of time, at least seven times over a period of time, at least eight times over a period of time, at least nine times over a period of times, at least ten times over a period of time, at least eleven times, at least twelve times over a period of time, at least thirteen times over a period of time, at least fourteen times over a period of time, at least fifteen times over a period of time, at least sixteen times over a period of time, at least seventeen times over a period of time, at least eighteen times over a period of time, at least nineteen times over a period of time, or at least twenty times over a period of time.

Optionally, such methods can further comprise assessing expression and/or activity of the inserted retinoschisin coding sequence or the encoded retinoschisin protein in the animal or in a cell. Various methods can be used to identify cells having a targeted genetic modification. The screening can comprise a quantitative assay for assessing modification of allele (MOA) of a parental chromosome. For example, the quantitative assay can be carried out via a quantitative PCR, such as a real-time PCR (qPCR). The real-time PCR can utilize a first primer set that recognizes the target locus and a second primer set that recognizes a non-targeted reference locus. The primer set can comprise a fluorescent probe that recognizes the amplified sequence. Other examples of suitable quantitative assays include fluorescence-mediated in situ hybridization (FISH), comparative genomic hybridization, isothermic DNA amplification, quantitative hybridization to an immobilized probe(s), INVADER® Probes, TAQMAN® Molecular Beacon probes, or ECLIPSE™ probe technology (see, e.g., US 2005/0144655, herein incorporated by reference in its entirety for all purposes).

Next-generation sequencing (NGS) can also be used for screening. Next-generation sequencing can also be referred to as "NGS" or "massively parallel sequencing" or "high throughput sequencing." NGS can be used as a screening tool in addition to the MOA assays to define the exact nature of the targeted genetic modification and whether it is consistent across cell types or tissue types or organ types.

Assessing modification of the target genomic locus in an animal can be in any cell type from any tissue or organ. For example, the assessment can be in multiple cell types from the same tissue or organ (e.g., eye) or in cells from multiple locations within the tissue or organ. This can provide information about which cell types within a target tissue or organ are being targeted or which sections of a tissue or organ are being reached by the nucleic acid construct. As another example, the assessment can be in multiple types of tissue or in multiple organs. In methods in which a particular tissue, organ, or cell type is being targeted, this can provide information about how effectively that tissue or organ is being targeted and whether there are off-target effects in other tissues or organs.

Methods for measuring expression of retinoschisin can include, for example, measuring protein expression. Such methods are well-known. Such methods can also comprise assessing expression of the mRNA encoded by the retinoschisin coding sequence. This measuring can be within the eye or particular cell types or regions within the eye (e.g., retinal cells such as photoreceptors).

One example of an assay that can be used is the BASESCOPE™ RNA in situ hybridization (ISH) assay, which a method that can quantify cell-specific edited transcripts, including single nucleotide changes, in the context of intact fixed tissue. The BASESCOPE™ RNA ISH assay can complement NGS and qPCR in characterization of gene editing. Whereas NGS/qPCR can provide quantitative average values of wild type and edited sequences, they provide no information on heterogeneity or percentage of edited cells within a tissue. The BASESCOPE™ ISH assay can provide a landscape view of an entire tissue and quantification of wild type versus edited transcripts with single-cell resolution, where the actual number of cells within the target tissue containing the edited mRNA transcript can be quantified. The BASESCOPE™ assay achieves single-molecule RNA detection using paired oligo ("ZZ") probes to amplify signal without non-specific background. However, the BASESCOPE™ probe design and signal amplification system enables single-molecule RNA detection with a 1 ZZ probe and it can differentially detect single nucleotide edits and mutations in intact fixed tissue.

Assays for measuring activity of a retinoschisin protein can include, for example, optical coherence tomography (OCT) and electroretinogram (ERG) testing. OCT scans can be used to score retinal cavities and/or to measure retinal photoreceptor thickness). Other assays include optokinetic tests. Such methods are well-known. For example, if the cell or animal being modified is a cell with a mutation that is associated with or causes X-linked juvenile retinoschisis (e.g., an R141C mutation), such functional assays can be used to assess rescue of the disease phenotype. Optical coherence tomography (OCT) provides high-resolution cross-sectional images of the macular region. In individuals with XLRS, OCT reveals cystic spaces primarily in the inner nuclear and outer plexiform layers of the retina. Such functional testing can also include electroretinogram (ERG) testing, which are diagnostic tests that measure the electrical activity generated by neural and non-neuronal cells in the retina in response to a light stimulus. XLRS is associated with reduced phototropic and scotopic b-wave amplitudes in ERGs.

All patent filings, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the invention can be used in combination with any other unless specifically indicated otherwise. Although the present invention has been described in some detail by way of illustration and example for purposes of clarity and understanding, it will be apparent that certain changes and modifications may be practiced within the scope of the appended claims.

BRIEF DESCRIPTION OF THE SEQUENCES

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. When a nucleotide sequence encoding an amino acid sequence is provided, it is understood that codon degenerate variants thereof that encode the same amino acid sequence are also provided. The amino acid sequences follow the standard convention of beginning at the amino terminus of the sequence and proceeding forward (i.e., from left to right in each line) to the carboxy terminus.

TABLE 4

Description of Sequences.

| SEQ ID NO | Type | Description |
| --- | --- | --- |
| 1 | Protein | Mouse Retinoschisin (UniProt Q9Z1L4) |
| 2 | Protein | Human Retinoschisin (UniProt O15537) |
| 3 | Protein | Human Retinoschisin R141C |
| 4 | Protein | Chimeric Mouse-Human Retinoschisin |
| 5 | Protein | Human Portion of Chimeric Human Retinoschisin |

TABLE 4-continued

Description of Sequences.

| SEQ ID NO | Type | Description |
|---|---|---|
| 6 | DNA | Human RS1 Coding Sequence (NCBI CCDS14187.1) |
| 7 | DNA | Mouse Rs1 Sequence in Hybrid cDNA |
| 8 | DNA | Human RS1 cDNA Exons 2-6 |
| 9 | DNA | Codon-Optimized Human RS1 cDNA Exons 2-6 |
| 10 | DNA | Reverse Complement of Codon-Optimized Human RS1 cDNA Exons 2-6 |
| 11 | DNA | $T^h$ Hybrid RSI cDNA |
| 12 | DNA | $T^{mh}$ Hybrid RS1 cDNA |
| 13 | DNA | $T^h$ Nucleotide Sequence (SA, hRS1, poly A) |
| 14 | DNA | $T^{mh}$ Hybrid RSI Sequence (SA, hRS1, poly A) |
| 15 | DNA | Fragment of Human RS1 Intron 1 with Splice Acceptor (V1) |
| 16 | DNA | Fragment of Human RS1 Intron 1 with Splice Acceptor (V1) |
| 17 | DNA | Mouse Splice Acceptor V1 |
| 18 | DNA | Mouse Splice Acceptor V2 |
| 19 | DNA | Reverse Complement of Mouse Splice Acceptor V1 |
| 20 | DNA | Reverse Complement of Mouse Splice Acceptor V2 |
| 21 | DNA | ADML Splice Acceptor |
| 22 | DNA | bGH Poly A |
| 23 | DNA | SV40 Poly A |
| 24 | DNA | Reverse Complement of SV40 PolyA |
| 25 | DNA | Human RSI PolyA |
| 26 | DNA | Cas9 DNA |
| 27 | Protein | Cas9 Protein |
| 28 | DNA | Cas9 cDNA |
| 29 | RNA | crRNA Tail |
| 30 | RNA | TracrRNA V1 |
| 31 | RNA | TracrRNA V2 |
| 32 | RNA | TracrRNA V3 |
| 33 | RNA | Guide RNA Scaffold V1 |
| 34 | RNA | Guide RNA Scaffold V2 |
| 35 | RNA | Guide RNA Scaffold V3 |
| 36 | RNA | Guide RNA Scaffold V4 |
| 37 | RNA | Guide RNA Scaffold V5 |
| 38 | RNA | Guide RNA Scaffold V6 |
| 39 | RNA | Guide RNA Scaffold V7 |
| 40 | DNA | Guide RNA Target Sequence Plus PAM V1 |
| 41 | DNA | Guide RNA Target Sequence Plus PAM V2 |
| 42 | DNA | Guide RNA Target Sequence Plus PAM V3 |
| 43 | RNA | Mouse Rsl Intron 1 Guide RNA |
| 44 | DNA | Generic Modified sgRNA |
| 45 | DNA | pAAVhRs1 cDNA, HITI |
| 46 | DNA | pscAAV Rs1 tandem. sgU |
| 47 | DNA | pAAV mhRs1 sgU |
| 48 | Protein | Mouse Retinoschisin R141C |
| 49 | Protein | NLS v1 |
| 50 | Protein | NLS v2 |
| 51 | Protein | NLS v3 |
| 52 | RNA | crRNA Tail v2 |
| 53 | RNA | Guide RNA Scaffold V8 |
| 54-1895 | DNA | Human RS1 Intron 1 Guide RNA Target Sequences |
| 1896-3147 | DNA | Mouse Rs1 Intron 1 Guide RNA Target Sequences |
| 3148-4989 | RNA | Human RS1 Intron 1 Guide Sequences |
| 4990-6241 | RNA | Mouse Rs1 Intron 1 Guide Sequences |
| 6242 | Protein | Cas9 Protein |
| 6243 | RNA | Cas9 mRNA |
| 6244 | DNA | Cas9 DNA |
| 6245 | RNA | Cas9 mRNA |
| 6246 | Protein | Cas9 Protein |
| 6247 | DNA | HDR-1800 Construct |
| 6248 | DNA | HDR-900 Construct |
| 6249 | DNA | HDR-450 Construct |

EXAMPLES

Example 1. Insertion of RS1 Coding Sequence into Mouse Rs1 Locus in XLRS Mouse Model In order to model potential X-linked juvenile retinoschisis therapy (XLRS) CRISPR therapeutics strategies in vivo, we generated a mouse line with constitutive expression of Cas9 protein in all tissues ($Rosa^{Cas9}/+$; see, e.g., US 2019/0032155 and WO 2019/028032, each of which is herein incorporated by reference in its entirety for all purposes) and crossed it to mice containing a mutant copy of murine retinoschisin (Rs1) ($Rs1^{R141C/Y}$) to generate $Rosa^{Cas9}/+$; $Rs1^{R141C/Y}$ mice. The mice with the Rs1 R141C mutation, which causes intracellular retention of retinoschisin to replicate key features of the human condition, including intraretinal schisis, retinal degeneration, and a reduced ERG b-wave.

The Rs1 gene is a highly conserved extracellular protein involved in the cellular organization of the retina. It is assembled and secreted from photoreceptors and bipolar cells as a homo-oligomeric protein complex. Over 200 mutations have been detected in Rs1, many leading to early onset of macular degeneration due to a non-functional protein or the absence of protein secretion. Lack of functional Rs1 expression causes schisis within the retinal layers leading to the early and progressive vision loss associated with XLRS. To date, there are no publications reporting pre-clinical or clinical studies using Cas9 technology for XLRS treatment. Here, we describe an approach for the use of Cas9 in combination with adeno-associated virus (AAV) to rescue the non-secreting R141C variant of Rs1 in mice. The constructs are designed to be integrated into the endogenous Rs1 locus in the retina (e.g., photoreceptors), where the hybrid mouse-human RS1 transcript will be expressed through the endogenous Rs1 promoter.

Figure 2:
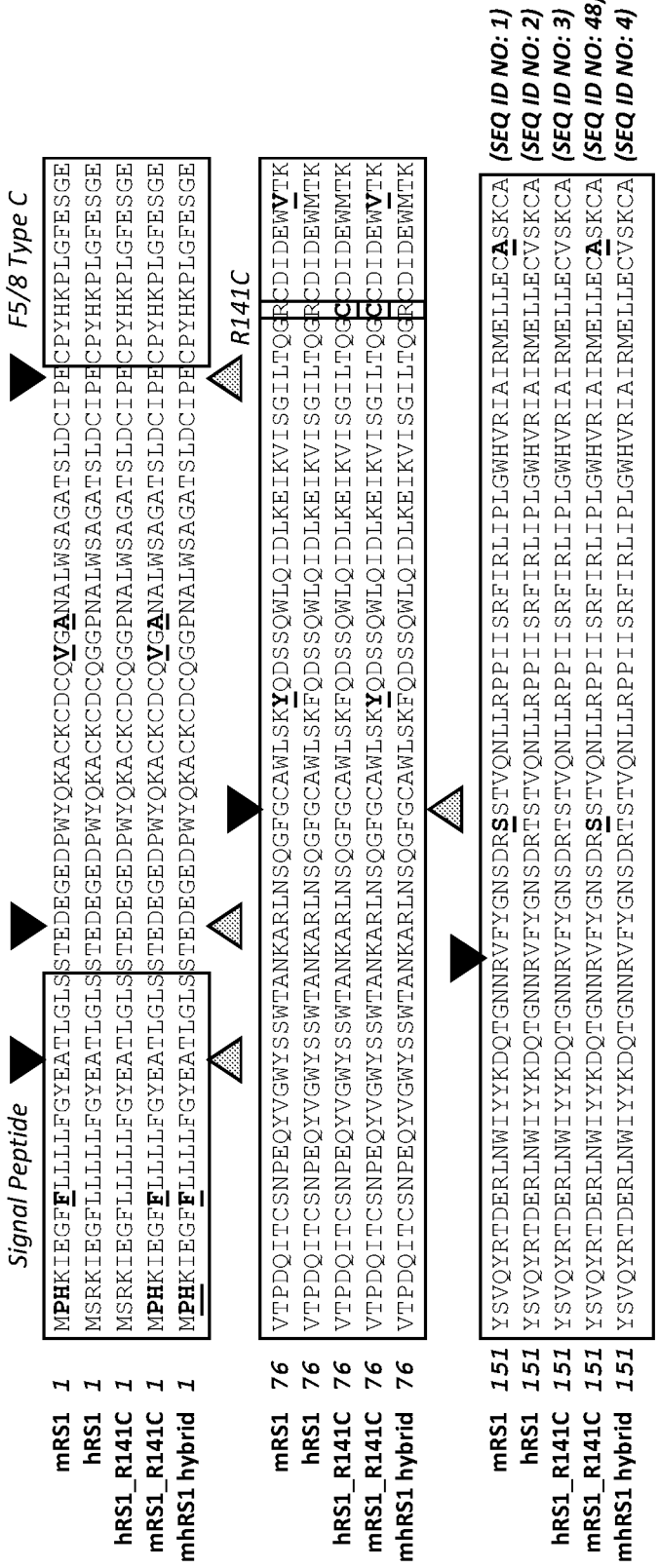
FIG. 2 shows an alignment of mouse retinoschisin, human retinoschisin, human retinoschisin with an R141C mutation, mouse retinoschisin with an R141C mutation, and a mouse/human retinoschisin hybrid expressed upon integration of a nucleic acid construct comprising exons 2-6 of human RS1 into intron 1 of the mouse Rs1 locus.

Subretinal delivery of AAV serotype 7m8 has led to successful expression of transgenes (data not shown). While AAVs have the potential to persist ectopically for a year or more, we endeavor to develop a strategy for permanent rescue of mutant Rs1 phenotypes. To this end, three viral vectors were designed encoding WT human RS1 exons 2-6 (without a promoter) as well as a guide RNA targeting mouse Rs1 intron 1. The sequence of the guide RNA is set forth in SEQ ID NO: 43, and the guide RNA target sequence in mouse Rs1 intron 1 is set forth in SEQ ID NO: 2383. Upon injection of any one of these viruses into RosaCas9/+; Rs1 R141C/Y mice, we expected the guide RNA expression to lead to cutting at the Rs1 locus and integration of the viral genome containing the human RS1 cDNA fragment. The mouse Rs1 locus is shown in FIG. 1. Mouse exon 1 would splice into human exon 2-6 cDNA (FIG. 2), and expression of the hybrid mouse human protein should prevent transcription of mutant mouse Rs1.

Figure 3A:
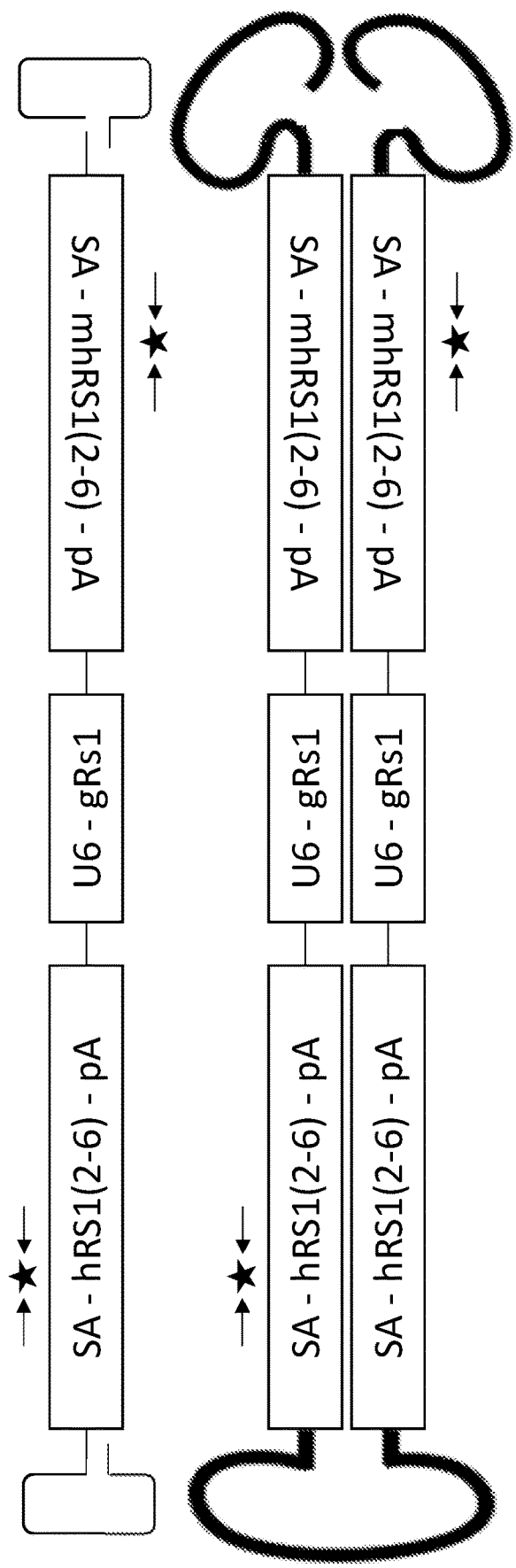
FIG. 3A (not to scale) shows a schematic of a bidirectional nucleic acid construct comprising a first segment comprising a splice acceptor (A), exons 2-6 of human RS1, and bovine growth hormone (bGH) polyA and a second segment comprising the reverse complement of SV40 polyA, the reverse complement of exons 2-6 of human RS1, and the reverse complement of a splice acceptor (A). The bidirectional construct also comprises a U6 promoter operably linked to a sequence encoding a guide RNA targeting intron 1 of the murine Rs1 locus in between the two human RS1 segments. The horizontal arrows flanking the star represent the next generation targeted resequencing amplicons designed for NGS. A bidirectional ssAAV construct is shown at the top, and a bidirectional scAAV construct is shown at the bottom.

Viral vector version 1 (SEQ ID NO: 47) was generated by bidirectional insertion in a single stranded AAV (ssAAV) vector. Two hundred bases of RS1 human intron 1 (containing exon 2 splice signals) were placed in front of a cDNA encoding exons 2-6 of human RS1 transcript followed by bovine growth hormone (bGH) polyA ($T^h$). A second human cDNA was generated with mouse codon optimization and integrated into the vector in the opposite orientation. This sequence was flanked by 200 bp containing the mouse splice signals and an SV40 polyA ($T^{mh}$). The sequences were designed to be divergent enough so as to reduce the likelihood of viral transcripts self-annealing. Further, an sgRNA expression unit was added in between the transcripts (FIG. 3A). The benefit of this strategy is that the viral genome can be inserted in either orientation and still form a viable reading frame for allele rescue.

Viral vector version 2 (SEQ ID NO: 46) was generated by bidirectional insertion in a self-complimentary AAV (scAAV) vector. This version is configured just as version 1, with two differences. First, the sequence was incorporated into a self-complimentary AAV vector. Second, to comply with the maximum self-complimentary genome size of 2100 bp, the splice signal regions were reduced to 60 bp (FIG. 3A).

Figure 3B:
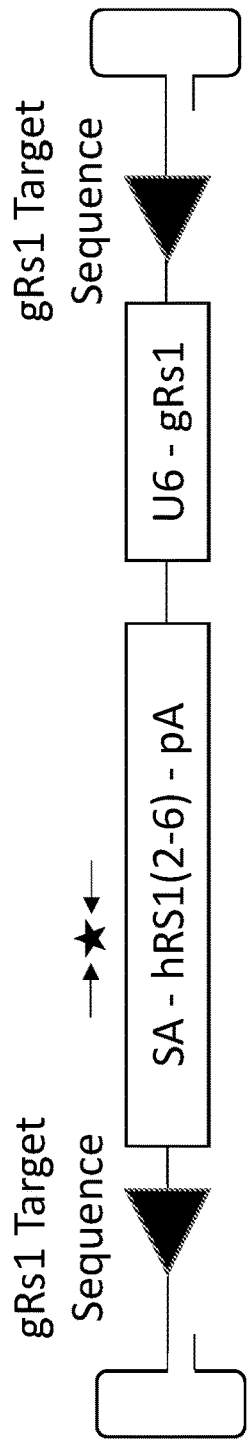
FIG. 3B (not to scale) shows a schematic for a homology-independent targeted integration nucleic acid construct comprising a splice acceptor (A), exons 2-6 of human RS1, and a polyA sequence. The construct also comprises a U6 promoter operably linked to a sequence encoding a guide RNA targeting intron 1 of the murine Rs1 locus downstream of the human RS1 segment. The horizontal arrows flanking the star represent the next generation targeted resequencing amplicons designed for NGS.

Viral vector version 3 (SEQ ID NO: 45) was designed for homology-independent targeted integration (HITI). HITI leverages the need for the Cas9 recognition sequence to have a protospacer adjacent motif (PAM). The construct was designed to express $T^h$ and the same guide RNA targeting the Rs1 intron 1. However, where versions 1 and 2 do not contain guide RNA target sequences, version 3 is flanked by an inverted guide RNA target sequence on each side (FIG. 3B). Once the viral genome is double-stranded, it will express one guide RNA sequence that should simultaneously cause a double-strand break in mouse Rs1 intron 1 as well as on both sides of the viral genome, effectively cleaving off the ITR sequences. The liberated viral genome is now free to insert into the mouse genome in either orientation. However, if the cDNA integrates in the reverse orientation, the guide RNA target sequences should be reconstituted and available for further Cas9 cleavage. If the cDNA integrates in the desired orientation, the guide RNA target sequences will be destroyed, and the sequence locked in place.

While the Rs1 sequences of version 1 and 2 are near identical, the viral backbones may change the timing of double-stranded viral production and thus impact gene insertion efficiencies. An scAAV will become double stranded faster than an ssAAV due to differences in the mechanism by which the second strand is synthesized. Both ITRs in ssAAVs can act as replication origins and contain single-stranded nuclease domains that cut newly synthesized strands. Replication can be initiated from either ITR, so a mixture of the + strand and − strand will be generated. Once the polymerase gets to the other ITR, the synthesized strand is cleaved and released. The primary mechanism to synthesize the compliment strand is to use host-cell machinery. However, at a low level, the + and − strands synthesized by the virus may spontaneously anneal to create the double-stranded virus. In the case of scAAV, one of the two ITR sequences is mutated to remove the nuclease domain. The replication fork starts at the active ITR and moves through the mutant ITR, without being cleaved, and the synthesis continues on the opposite strand. The single-stranded synthesis containing both the + and − strand self-compliment to make the double-stranded virus.

Versions 1-3 were each able to mediate gene insertion at the mouse Rs1 locus in the Cas9 mouse background. In the pilot study, a small amount of virus was injected into right eye of each mouse, and the left eye was not injected as a control. Both retinas were harvested and cut in half. Half of each retina was used for non-homologous end joining (NHEJ) characterization at the intron 1 of mouse Rs1 locus. The other half was used to generate cDNA for NGS amplicon sequencing over the mutant region. Due to PCR efficiencies and bias, we were able to amplify each transcript variant, but we could not quantify the actual expression profiles. NHEJ characterization provides a clue to guide RNA activity as well as insertion activity. Detection of NHEJ implies an allele without gene insertion that will likely express the mutant mouse transcript. Detection of either modified transcript indicates that gene insertion has occurred.

Figure 4:
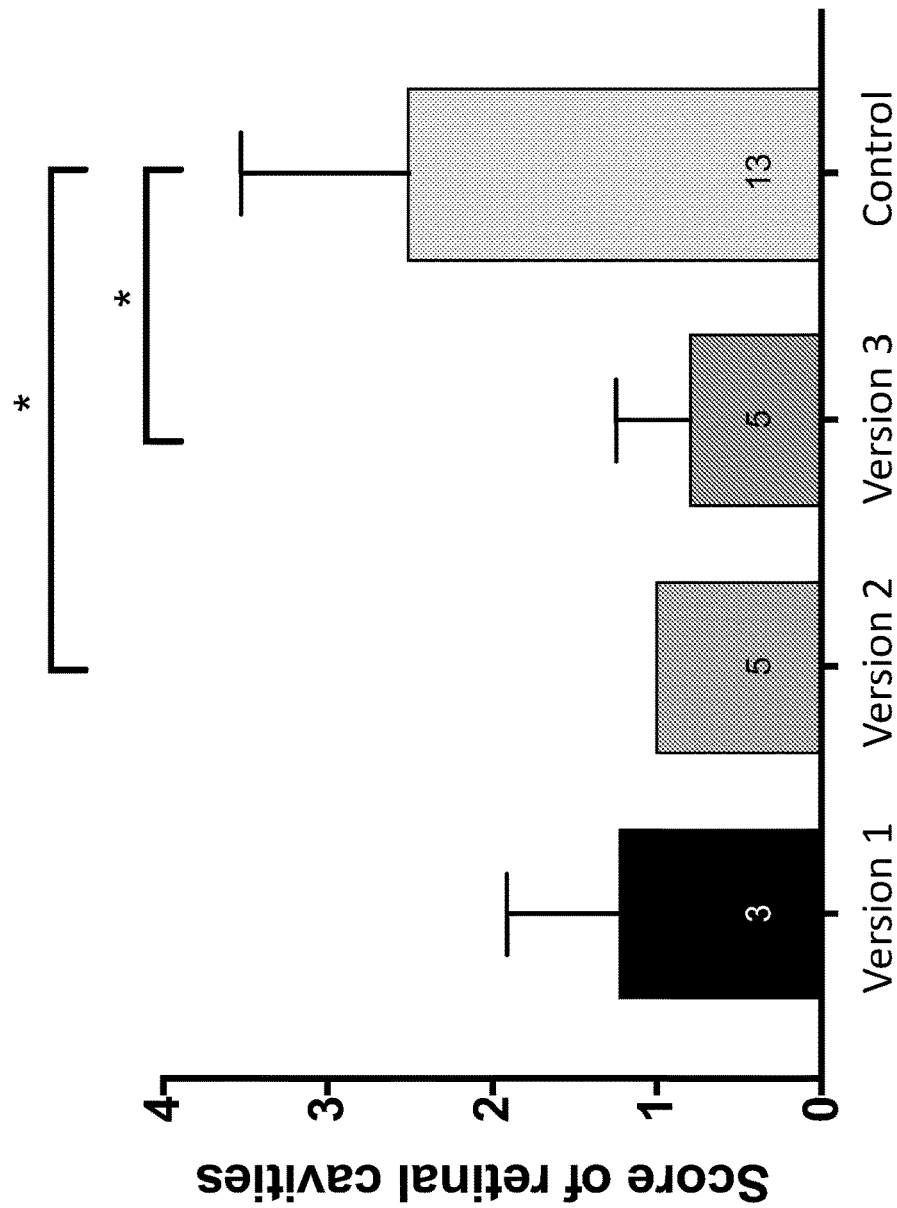
FIG. 4 shows scoring of retinal cavities shown in optical coherence tomography (OCT) scans in eyes from $Rosa^{Cas9}/+$; $Rs1^{R141C/Y}$ mice injected with RS1 viral vector version 1, RSJ viral vector version 2, or RS1 viral vector version 3. A score of 1 was assigned if there were 1-4 cavities on at least one individual image. A score of 2 was assigned if there were ≥4 cavities on at least one individual image, but the cavities were not fused. A score of 3 was assigned if there were fused cavities on at least one individual image. A score of 4 was assigned if there were fused cavities on at least one individual image and the retina was stretched. The average scores for each treatment group were compared with a control group containing the pooled non-treated eyes by nonparametric Kruskal-Wallis one-way analysis of variance and Post hoc test Dunn's multiple comparisons test.

Thirteen mice were injected in the right eyes: three for version 1, and five each for versions 2 and 3. All injected eyes had improved retinal organization as seen in optical coherence tomography (OCT) imaging. See FIG. 4. Scoring of retinal cavities shown in OCT scans (containing 61 images each) from 3 different locations of each eye was conducted based on the following preset criteria by three independent readers. A score of 1 was assigned if there were 1-4 cavities on at least one individual image. A score of 2 was assigned if there were ≥4 cavities on at least one individual image, but the cavities were not fused. A score of 3 was assigned if there were fused cavities on at least one individual image. A score of 4 was assigned if there were fused cavities on at least one individual image and the retina was stretched. The average scores for each treatment group were compared with a control group containing the pooled non-treated eyes by nonparametric Kruskal-Wallis one-way analysis of variance and Post hoc test Dunn's multiple comparisons test.

Figure 7A:
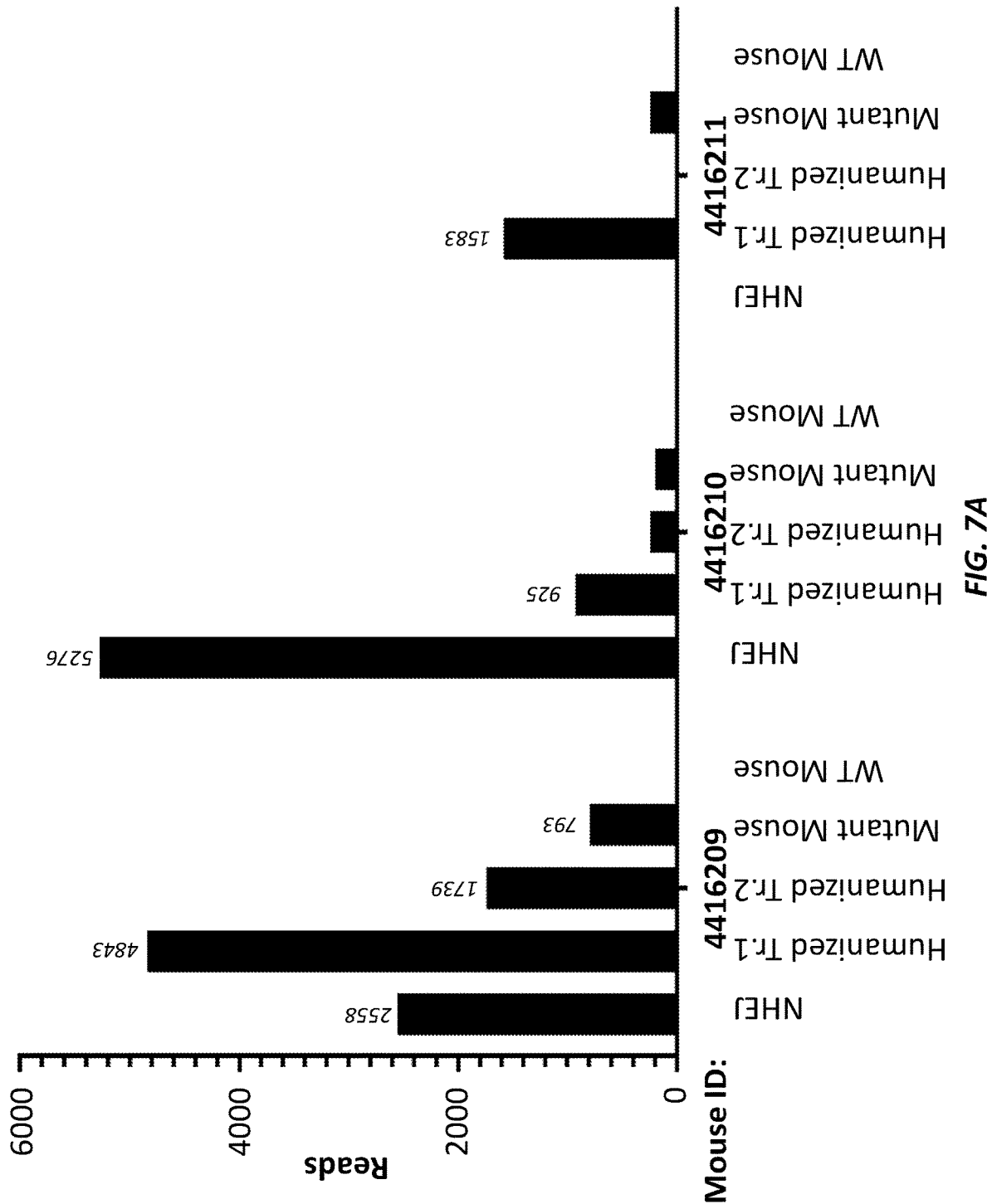
FIGS. 7A-7C show NGS results from mouse retina samples in eyes from $Rosa^{Cas9/+}$; $RS1^{R141C/Y}$ mice injected with RS1 viral vector version 1 (pssAAV mhRS1-sgu.
Figure 7B:
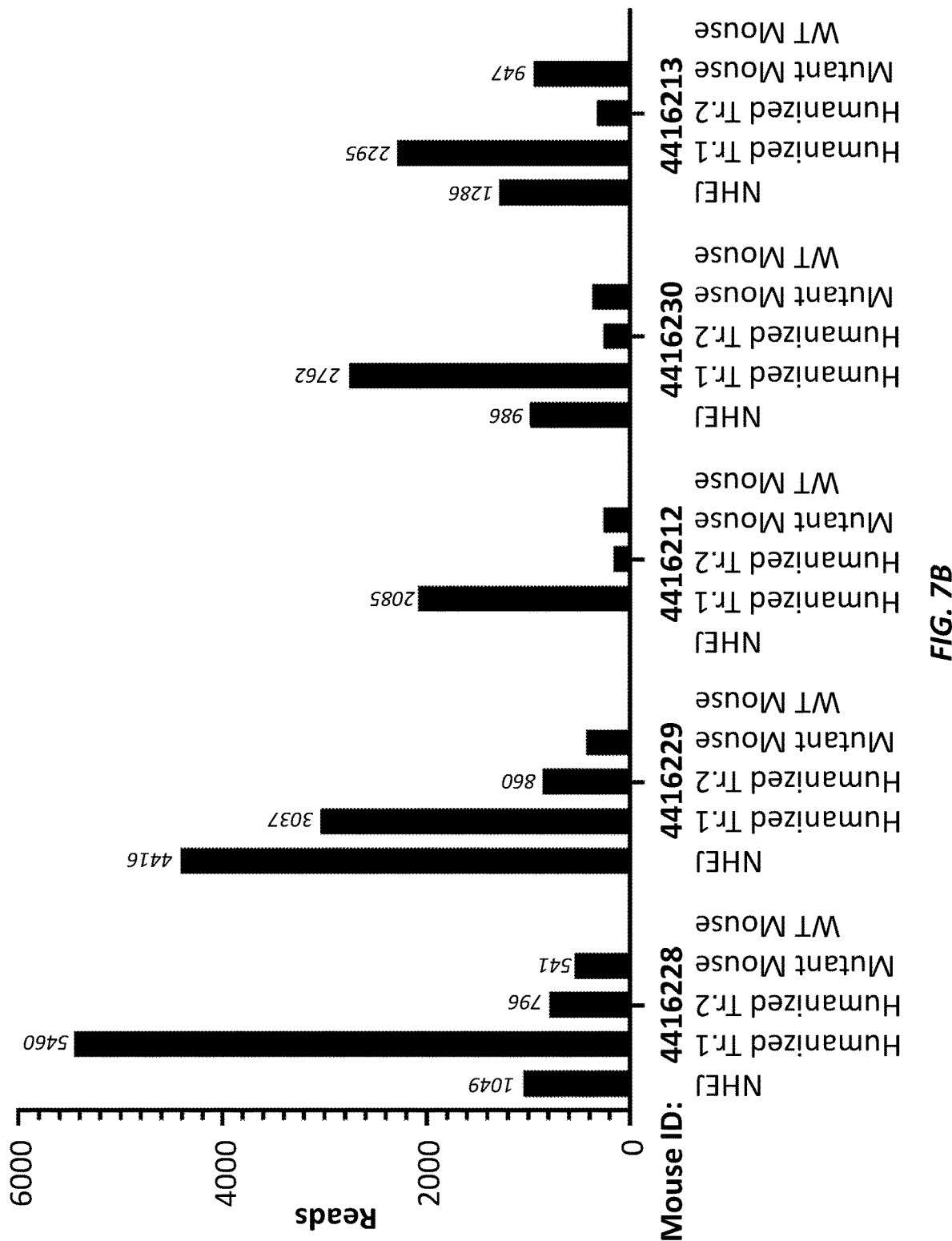
Figure 7C:
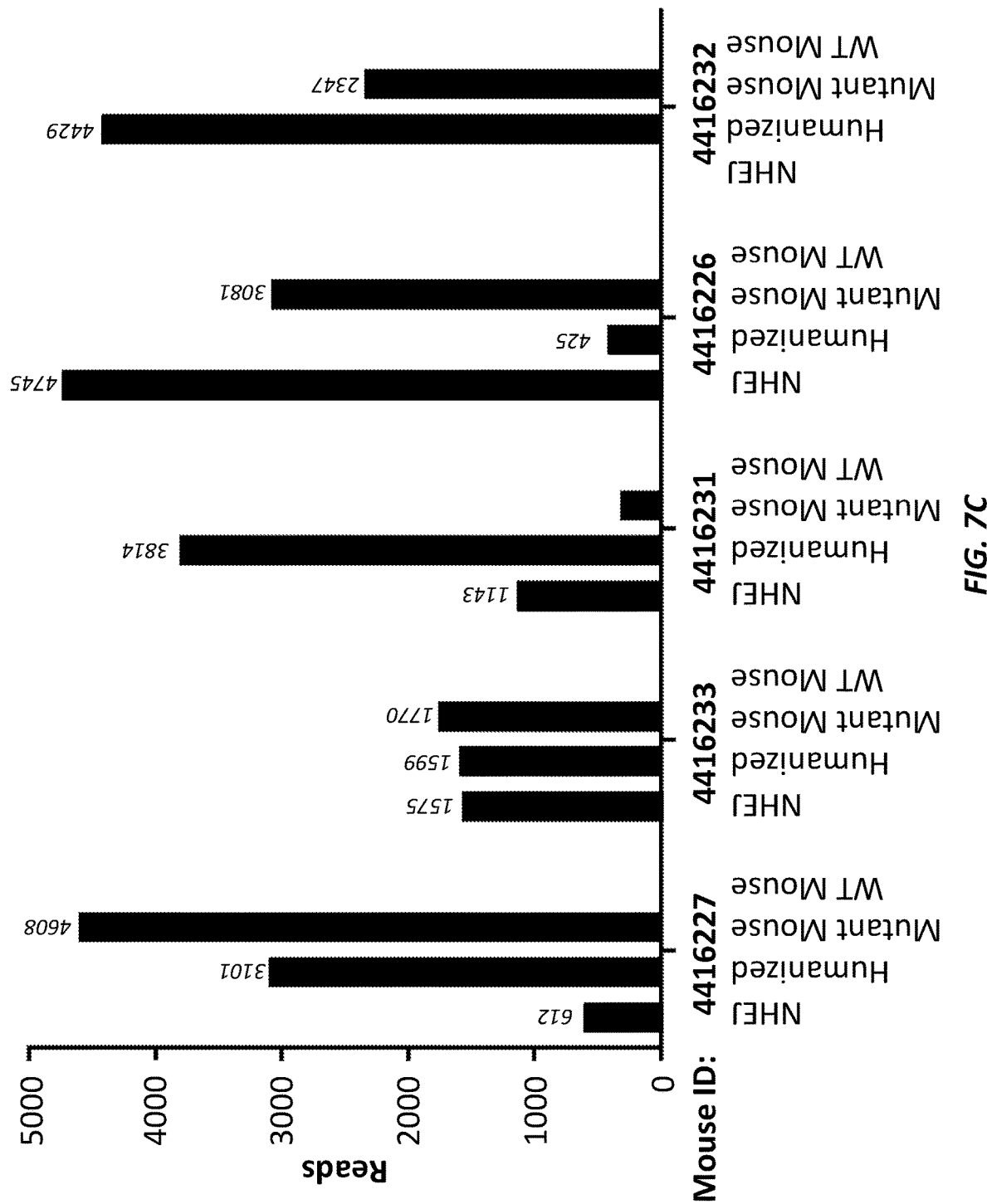

Next generation targeted resequencing amplicons were designed for the regions depicted in FIG. 3 (horizontal arrows) as these regions are distinct in the four expected sequence variants ((1) WT mouse, the mouse reference sequence not containing the R141C mutant; (2) mutant mouse, the mouse reference sequence harboring the R141C mutant; (3) humanized transcript 1, the human reference sequence; and (4) humanized transcript 2, the mouse codon-optimized human reference sequence). Mouse retinas were harvested from study mice and total mRNA was extracted from the tissues. mRNA was used to generate cDNA to act as a template for next generation sequencing (NGS) amplification. Target-specific oligos with incorporated barcodes for sequence identification were used to amplify all four variants per tissue. The PCR products from each mouse were normalized and pooled into a single tube for further preparation. The finalized library was loaded on to a MiSeq and the 2×300 program was used to sequence samples. Informatic codes were then used to deconvolute the samples and create a de novo sequence reference. The number of reads that matched each variant were quantified and the percentage was obtained by dividing the variant read count by the total read count. As expected, WT mouse sequences were only found in female $Rosa^{Cas9/+};Rs1^{R141C/+}$ mice. The NGS results for the four expected sequence variants are shown in FIG. 5. PCR bias and efficiency are not accounted for. A separate amplicon was used to amplify the Rs1 intron 1 guide RNA target sequence. Reads that matched the mouse reference sequence or contained non-homologous end joining were quantified to assess how often the guide RNA cut without making an insertion. See FIGS. 6A and 6B. Bar graphs showing some of the data from the tables in FIG. 5 are shown in FIGS. 7A-7C for versions 1-3, respectively.

All mice showed varying levels of all transcripts, with more $T^h$ reads than $T^{mh}$ reads in all mice. As expected, mice with very high NHEJ rates had lower amounts of human transcripts present. While versions 1 and 2 had similar sequence profiles, version 3 had a greater presence of residual mutant mouse transcript. This was likely due to the need for a specific insertion orientation. While the guide RNA design should help to push the insertion towards the desired insertion, it is likely that Cas9 cleavage damaged the recognition sequences beyond the possibility of re-targeting. Additionally, a large insertion/deletion (indel) on the viral genome may have disrupted the splice signals and prevented proper expression.

Example 2. Insertion of RS1 Coding Sequence into Human RS1 Locus in Human Retinoblastoma Cells We next tested insertion of RS1 coding sequence into the human RS1 locus in WERI-Rb1 human retinoblastoma cells in vitro. The WERI-Rb1 cell line (ATCC® HTB 169™) was derived from human retinoblastoma. Retinoblastoma cells are precursors of photoreceptors and are an appropriate in vitro photoreceptor cell model because photoreceptor cell lines are not available. The cells were characterized in-house with retinal specific cell markers by ICC and RT-PCR, which showed only cone-specific mRNAs/proteins but not their rod counterparts were found, suggesting that this neoplasm was of cone cell lineage. In addition, RS1 was reported to be expressed and released by WERI-Rb1 cells. We also detected RS1 expression at mRNA level and protein levels (data not shown). Lipid nanoparticles (LNPs) were formulated with one of six guide RNAs targeting intron 1 of the human RS1 and Cas9 mRNA (sequence set forth in SEQ ID NO: 6245).

TABLE 5

Human RS1 Guide RNAs.

| gRNA | Guide RNA Target Sequence (5' to 3') | Direction | SEQ ID NO |
|---|---|---|---|
| hG1 | CTGTATCTTCTTAGCCAGTA | + | 57 |
| hG2 | CCCTTTTGTACGTTTTTTAA | + | 56 |
| hG3 | AAAAAAGGACTTGACATGCA | + | 65 |
| hG4 | AGAGCTTTGGCCGAGGACGA | + | 1210 |
| hG5 | TCTAGGACTTCTTCGCATCG | - | 1203 |
| hG6 | AGTCTGAGGCTGGGGCAACT | - | 581 |

Figure 8A:
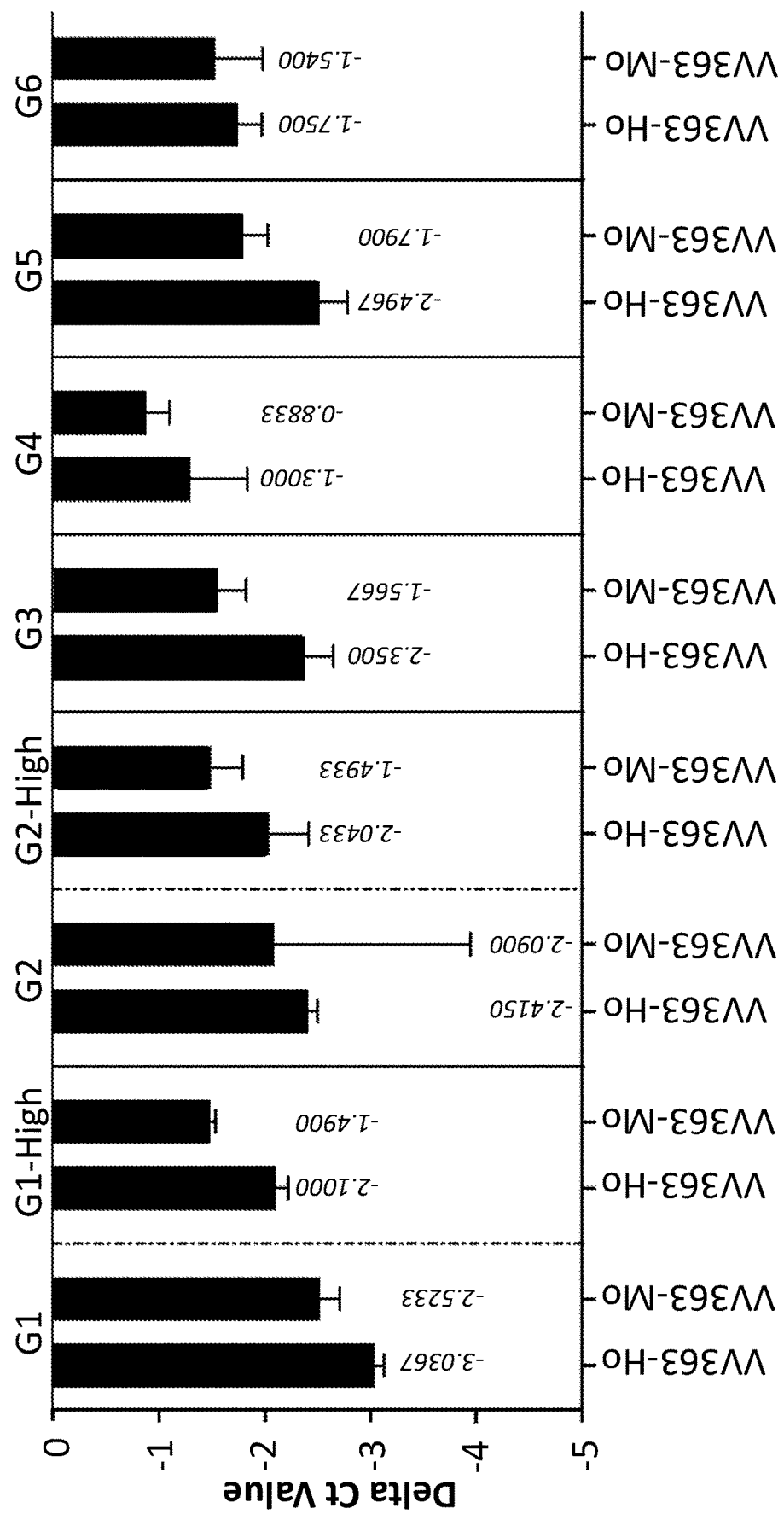
FIGS. 8A and 8B show RT-qPCR results from human retinoblastoma cells treated with RS1 viral vector version 1 (pssAAV mhRS1-sgu.
Figure 8B:
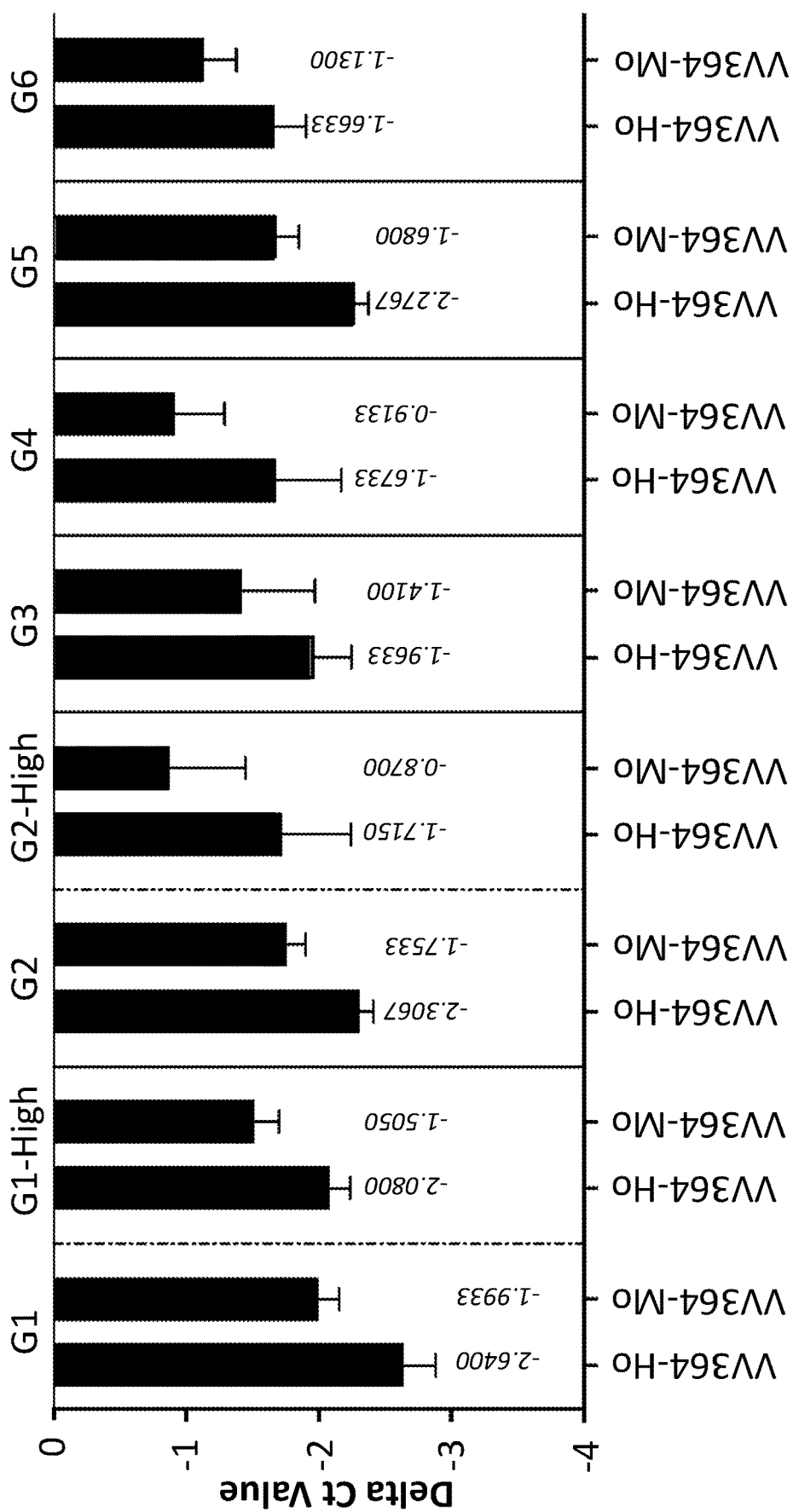
Figure 9A:
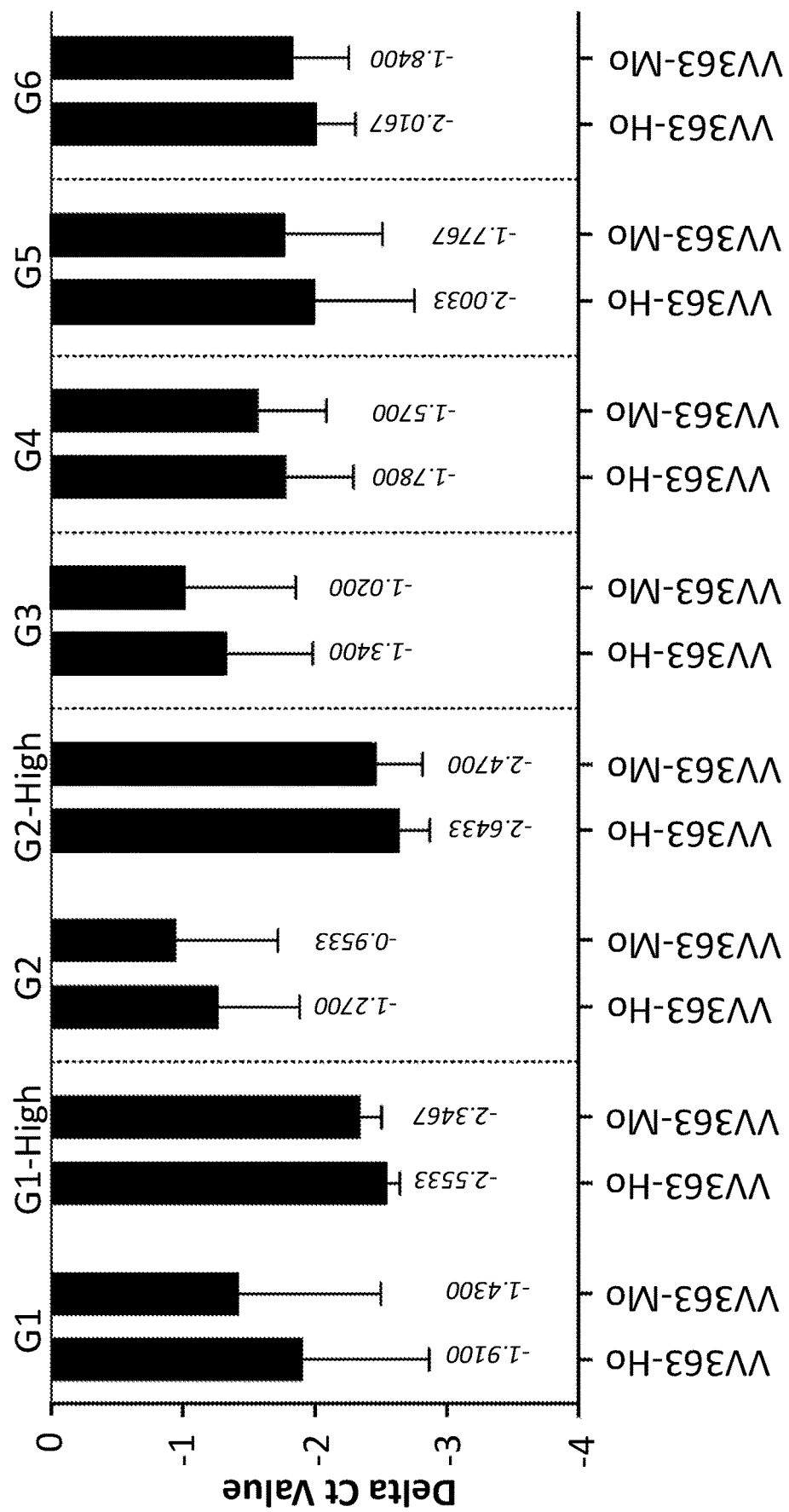
FIGS. 9A and 9B show RT-qPCR results from human retinoblastoma cells treated with RS1 viral vector version 1 (pssAAV mhRS1-sgu.
Figure 9B:
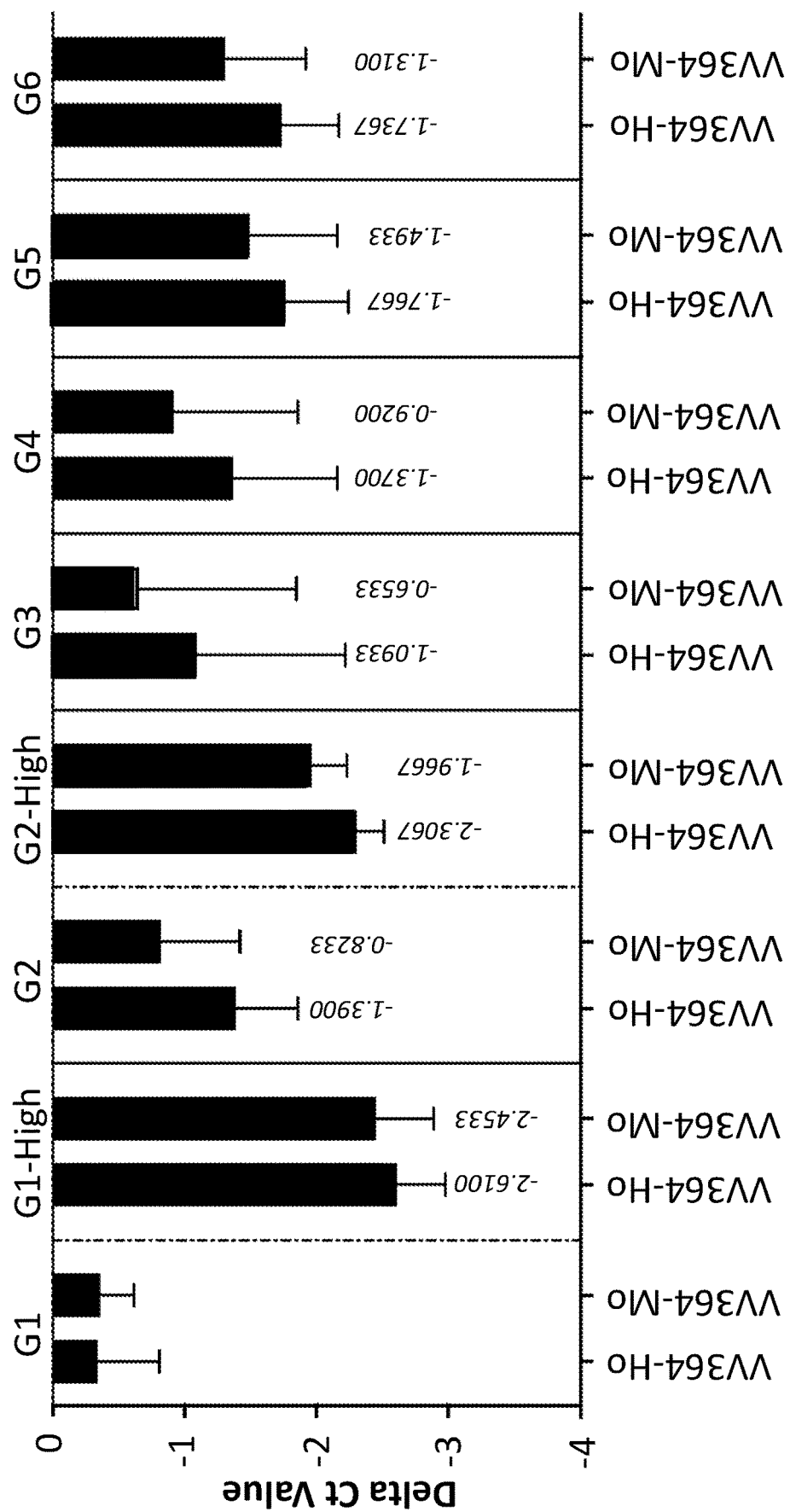

In a first experiment, human retinoblastoma cells in suspension were transduced with approximately 5e5 MOI of AAV donor (viral vector versions 1 and 2 from Example 1), and CRISPR/Cas9 LNPs were administered 2 hours post-infection. All LNPs were dosed at 500 ng per well (48-well plate), except the "high" samples, which were dosed at 1000 ng LNP. Complete gene expression analysis by RT-qPCR was then done. RT-qPCR was performed by harvesting the total RNA from samples and treating them with DNAse to degrade all DNA contained in the samples. Next, the RNA samples were subjected to reverse transcription to create cDNA for all mRNA contained in the sample. Target specific TaqMan assays were then used to quantify the unique RS1 sequences expressed in the cells. RNA was harvested 72 hours post-infection. A no reverse transcription control was completed by harvesting the total RNA and DNAase treating as above. For the control, the reverse transcription polymerase was replaced with water such that no cDNA should be generated. Reverse transcribed and control non-reverse transcribed samples were run with a housekeeping gene (DROSHA). Results for viral vector version 1 (bidirectional insertion in a single stranded AAV (ssAAV) vector) are shown in FIG. 8A. Results for viral vector version 1 (bidirectional insertion in a self-complimentary AAV (scAAV) vector) are shown in FIG. 8B. These results are shown as delta Ct in order to normalize differences in RNA quantity and quality. The lower the number, the higher the expression of the target sequence. These results indicate robust expression of the introduced sequences. TaqMan assays and viral sequences were optimized to reduce cross-detection of the endogenous human RS1 expression. In a second experiment, human retinoblastoma cells in suspension were transduced with approximately 5e5 MOI of AAV donor (viral vector versions 1 and 2 from Example 1), and CRISPR/Cas9 LNPs were administered 2 hours prior to infection. All LNPs were dosed at 500 ng per well (48-well plate), except the "high" samples, which were dosed at 1000 ng LNP. Complete gene expression analysis by RT-qPCR was then done. Results for viral vector version 1 (bidirectional insertion in a single stranded AAV (ssAAV) vector) are shown in FIG. 9A. Results for viral vector version 1 (bidirectional insertion in a self-complimentary AAV (scAAV) vector) are shown in FIG. 9B. These results are shown as delta Ct in order to normalize differences in RNA quantity and quality. The lower the number, the higher the expression of the target sequence. These results indicate robust expression of the introduced sequences. TaqMan assays and viral sequences were optimized to reduce cross-detection of the endogenous human RS1 expression.

Example 3. Insertion of RS1 Coding Sequence into Mouse Rs1 Locus in XLRS Mouse Model Via Homologous Recombination In order to model potential X-linked juvenile retinoschisis therapy (XLRS) CRISPR therapeutics strategies in vivo, we use the mouse line described in Example 1 with constitutive expression of Cas9 protein in all tissues crossed to mice containing a mutant copy of murine retinoschisin (Rs1) (Rosa$^{Cas9}$/+; Rs1$^{R141C/Y}$ mice). CRISPR/Cas9 is used in combination with adeno-associated virus (AAV) to rescue the non-secreting R141C variant of Rs1 in mice. The constructs are designed to be integrated into the endogenous Rs1 locus in the retina (e.g., photoreceptors) via homologous recombination, where the hybrid mouse-human RS1 transcript will be expressed through the endogenous Rs1 promoter. The mice are at the age of P14 when the retina is still undergoing mitosis, cellular differentiation, and maturation. Injection is during mitosis of the retina, and the evaluation is post-mitosis at 2 months post-injection.

Figure 10:
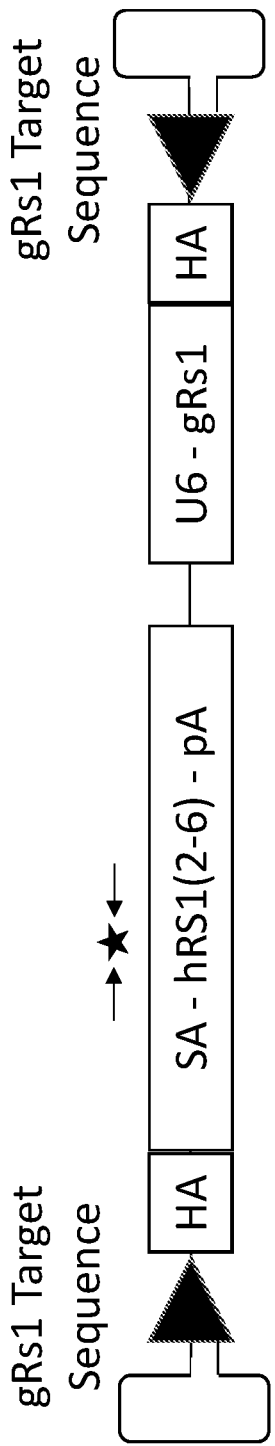
FIG. 10 shows a schematic for a nucleic acid construct for homologous recombination comprising a splice acceptor (A), exons 2-6 of human RS1, and a polyA sequence. The construct also comprises a U6 promoter operably linked to a sequence encoding a guide RNA targeting intron 1 of the murine Rs1 locus downstream of the human RS1 segment. The construct also comprises upstream and downstream homology arms (HA). The horizontal arrows flanking the star represent the next generation targeted resequencing amplicons designed for NGS.

Three viral vectors were designed encoding WT human RS1 exons 2-6 (without a promoter) as well as a guide RNA targeting mouse Rs1 intron 1 (guide RNA target sequence set forth in SEQ ID NO: 2887), with all of these elements flanked by homology arms. See FIG. 10. These elements are flanked by an inverted guide RNA target sequence on each side. Once the viral genome is double-stranded, it will express one guide RNA sequence that simultaneously causes a double-strand break in mouse Rs1 intron 1 as well as on both sides of the viral genome, effectively cleaving off the ITR sequences. The homology arms in the first viral vector are approximately 1800 bp each, the homology arms in the second viral vector are approximately 900 bp each, and the homology arms in the third viral vector are approximately 450 bp each. The sequences for the three vectors are set forth in SEQ ID NOS: 6247-6249, respectively. Upon injection of any one of these viruses into the eye of RosaCas9/+; Rs1R141C/Y mice, guide RNA expression leads to cutting at the Rs1 locus and homologous recombination with the viral genome containing the human RS1 cDNA fragment. The mouse Rs1 locus is shown in FIG. 1. Mouse exon 1 splices into human exon 2-6 cDNA (FIG. 2), and expression of the hybrid mouse human protein prevents transcription of mutant mouse Rs1.

Retinas are harvested and cut in half. Half of each retina is used for non-homologous end joining (NHEJ) characterization at the intron 1 of mouse Rs1 locus. The other half is used to generate cDNA for NGS amplicon sequencing over the mutant region. NHEJ characterization provides information on guide RNA activity as well as insertion activity. Detection of NHEJ implies an allele without gene insertion that will likely express the mutant mouse transcript. Detection of the inserted transcript indicates that gene insertion has occurred.

Retinal organization is assessed by optical coherence tomography (OCT) imaging. Scoring of retinal cavities in OCT scans is conducted based on the following preset criteria by three independent readers. A score of 1 is assigned if there are 1-4 cavities on at least one individual image. A score of 2 is assigned if there are ≥4 cavities on at least one individual image, but the cavities are not fused. A score of 3 is assigned if there are fused cavities on at least one individual image. A score of 4 is assigned if there are fused cavities on at least one individual image and the retina is stretched. The average scores for each treatment group are compared with a control group containing the pooled non-treated eyes by nonparametric Kruskal-Wallis one-way analysis of variance and Post hoc test Dunn's multiple comparisons test.

Mouse retinas are harvested from study mice, and total mRNA is extracted from the tissues. mRNA is used to generate cDNA to act as a template for next generation sequencing (NGS) amplification. Target-specific oligos with incorporated barcodes for sequence identification are used to amplify all variants per tissue. The PCR products from each mouse are normalized and pooled into a single tube for further preparation. The finalized library is loaded on to a MiSeq, and the 2×300 program is used to sequence samples. Informatic codes are then used to deconvolute the samples and create a de novo sequence reference. The number of reads that match each variant are quantified, and the percentage is obtained by dividing the variant read count by the total read count.

Example 4. Insertion of RS1 Coding Sequence into Human RS1 Locus in Human Retinoblastoma Cells Via Homologous Recombination We next test insertion of RS1 coding sequence into the human RS1 locus via homologous recombination in human retinoblastoma cells in vitro. Lipid nanoparticles (LNPs) are formulated with guide RNAs targeting intron 1 of the human RS1 and Cas9 mRNA. In a first experiment, human retinoblastoma cells in suspension are transduced with approximately 5e5 MOI of AAV donor (viral vectors from Example 3, but with human RS1 homology arms), and CRISPR/Cas9 LNPs are administered 2 hours post-infection. All LNPs are dosed at 500 ng per well or 1000 ng per well. Complete gene expression analysis by RT-qPCR is then done. In a second experiment, human retinoblastoma cells in suspension are transduced with approximately 5e5 MOI of AAV donor (viral vectors from Example 3, but with human RS1 homology arms), and CRISPR/Cas9 LNPs were administered 2 hours prior to infection. All LNPs were dosed at 500 ng per well or 1000 ng per well. Complete gene expression analysis by RT-qPCR is then done.

---

SEQUENCE LISTING (6249 sequences)

SEQ ID NO: 1 - protein, 224 aa, Mus musculus
MPHKIEGFFLLLLFGYEATLGLSSTEDEGEDPWYQKACKCDCQVGANALWSAGATSLDCIPECPYHKPLGFESGEVTPDQITCSNPEQYVGWYSSWTANKARLNSQGFGCAWLSKYQDSSQWLQIDLKEIKVISGILTQGRCDIDEWVTKYSVQYRTDERLNWIYYKDQTGNNRVFYGNSDRSSTVQNLLRPPIISRFIRLIPLGWHVRIAIRMELLECASKCA

SEQ ID NO: 2 - protein, 224 aa, Homo sapiens
MSRKIEGFLLLLLFGYEATLGLSSTEDEGEDPWYQKACKCDCQGGPNALWSAGATSLDCIPECPYHKPLGFESGEVTPDQITCSNPEQYVGWYSSWTANKARLNSQGFGCAWLSKFQDSSQWLQIDLKEIKVISGILTQGRCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 3 - protein, 224 aa, Homo sapiens
MSRKIEGFLLLLLFGYEATLGLSSTEDEGEDPWYQKACKCDCQGGPNALWSAGATSLDCIPECPYHKPLGFESGEVTPDQITCSNPEQYVGWYSSWTANKARLNSQGFGCAWLSKFQDSSQWLQIDLKEIKVISGILTQGCCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 4 - protein, 224 aa, Artificial Sequence
  Synthetic
MPHKIEGFFLLLLFGYEATLGLSSTEDEGEDPWYQKACKCDCQGGPNALWSAGATSLDCIPECPYHKPLGFESGEVTPDQITCSNPEQYVGWYSSWTANKARLNSQGFGCAWLSKFQDSSQWLQIDLKEIKVISGILTQGRCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 5 - protein, 206 aa, Homo sapiens
TLGLSSTEDEGEDPWYQKACKCDCQGGPNALWSAGATSLDCIPECPYHKPLGFESGEVTPDQITCSNPEQYVGWYSSWTANKARLNSQGFGCAWLSKFQDSSQWLQIDLKEIKVISGILTQGRCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 6 - DNA, 675 bp, Homo sapiens
atgtcacgcaagatagaaggctttttgttattacttctctttggctatgaagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctga

SEQ ID NO: 7 - DNA, 52 bp, Mus musculus
atgccacacaagattgaaggcttcttcttgttacttctctttggctatgaag

SEQ ID NO: 8 - DNA, 623 bp, Homo sapiens
ccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctga

SEQ ID NO: 9 - DNA, 623 bp, Artificial Sequence
  Synthetic
ccacactgggcctgagcagcacagaagatgaaggcgaggacccctggtatcagaaagcctgcaagtgcgactgtcaaggcggccctaatgctctttggagcgctggcgctacaagcctggactgcatccctgagtgcccctaccataagcctctgggcttcgagagcggcgaagtgacccctgaccagatcacctgtagcaaccccgagcagtacgtcggctggtactctagctggacagccaacaaggccagactgaacagccaaggcttcggctgtgcctggctgagcaagttccaggactctagccagtggctgcagatcgacctgaaagagatcaaagtcatcagcggcatcctgacacagggcagatgcgacatcgacgagtggatgaccaagtacagcgtgcagtacagaaccgacgagagactgaactggatctactacaaggaccagaccggcaacaacagagtgttctacggcaacagcgacagaaccagcaccgtgcagaatctgctgaggcctcctatcatctccagattcatcagactgatccctctcggctggcacgtgcggatcgccatcagaatggaactgctggaatgcgtgtccaagtgcgcctga

SEQ ID NO: 10 - DNA, 623 bp, Artificial Sequence
  Synthetic
tcaggcgcacttggacacgcattccagcagttccattctgatggcgatccgcacgtgccagccgagagggatcagtctgatgaatctggagatgataggaggcctcagcagattctgcacggtgctggttctgtcgctgttgccgtagaacactctgttgttgccggtctggtccttgtagtagatccagttcagtctctcgtcggttctgtactgcacgctgtacttggtcatccactcgtcgatgtcgcatctgccctgtgtcaggatgccgctgatgactttgatctctttcaggtcgatctgcagccactggctagagtcctggaacttgctcagccaggcacagccgaagccttggctgttcagtctggccttgttggctgtccagctagagtaccagccgacgtactgctcggggttgctacaggtgatctggtcaggggtcacttcgccgctctcgaagcccagaggcttatggtaggggcactcagggatgcagtccaggcttgtagcgccagcgctccaaagagcattagggccgccttgacagtcgcacttgcaggctttctgataccaggggtcctcgccttcatcttctgtgctgctcaggcccagtgtgg

SEQ ID NO: 11 - DNA, 675 bp, Artificial Sequence
  Synthetic
  misc_feature (1)..(52): Mouse Sequence
  misc_feature (53)..(675): Human Sequence
atgccacacaagattgaaggcttcttcttgttacttctctttggctatgaagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctga

SEQ ID NO: 12 - DNA, 675 bp, Artificial Sequence
  Synthetic
  misc_feature (1)..(52): Mouse Sequence
  misc_feature (53)..(675): Human Sequence
atgccacacaagattgaaggcttcttcttgttacttctctttggctatgaagccacactgggcctgagcagcacagaagatgaaggcgaggacccctggtatcagaaagcctgcaagtgcgactgtcaaggcggccctaatgctctttggagcgctggcgctacaagcctggactgcatccctgagtgcccctaccataagcctctgggcttcgagagcggcgaagtgacccctgaccagatcacctgtagcaaccccgagcagtacgtcggctggtactctagctggacagccaacaaggccagactgaacagccaaggcttcggctgtgcctggctgagcaagttccaggactctagccagtggctgcagatcgacctgaaagagatcaaagtcatcagcggcatcctgacacagggcagatgcgacatcgacgagtggatgaccaagtacagcgtgcagtacagaaccgacgagagactgaactggatctactacaaggaccagaccggcaacaacagagtgttctacggcaacagcgacagaaccagcaccgtgcagaatctgctgaggcctcctatcatctccagattcatcagactgatccctctcggctggcacgtgcggatcgccatcagaatggaactgctggaatgcgtgtccaagtgcgcctga

SEQ ID NO: 13 - DNA, 1073 bp, Artificial Sequence
  Synthetic
  misc_feature (1)..(224): Intron with Splice Acceptor
  misc_feature (225)..(847): Human RS1 Sequence
  misc_feature (848)..(1073): bGH polyA
ctataatgatgatcttgttctttctgtttaattttactgtccctagcttcttagcatctgcggatgtttttcctggcagatatttactcaccatgacttcttccagaaggggtgttggtagctttcatgtgactatttctatttcacttttccatgtaacgagtgatgctgttggatttctctttcattaattagattttttctgtctcatccttttgctttagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggc

SEQ ID NO: 14 - DNA, 1028 bp, Artificial Sequence
  Synthetic
  misc_feature (1)..(183): Intron with Splice Acceptor
  misc_feature (184)..(806): Mouse-Codon-Optimized Human RS1
  misc_feature (807)..(1028): SV40 polyA
gctgtactgcaccctgctttgctatattaatatattttccataattctataagaaaaaacaacagtcattgccatccttttcctccctccagaatgagctccttaatctctatggcattgttttcattttgccttctttcctttcttaatttcattttttccctctcttgttcttttgctcagccacactgggcctgagcagcacagaagatgaaggcgaggacccctggtatcagaaagcctgcaagtgcgactgtcaaggcggccctaatgctctttggagcgctggcgctacaagcctggactgcatccctgagtgcccctaccataagcctctgggcttcgagagcggcgaagtgacccctgaccagatcacctgtagcaaccccgagcagtacgtcggctggtactctagctggacagccaacaaggccagactgaacagccaaggcttcggctgtgcctggctgagcaagttccaggactctagccagtggctgcagatcgacctgaaagagatcaaagtcatcagcggcatcctgacacagggcagatgcgacatcgacgagtggatgaccaagtacagcgtgcagtacagaaccgacgagagactgaactggatctactacaaggaccagaccggcaacaacagagtgttctacggcaacagcgacagaaccagcaccgtgcagaatctgctgaggcctcctatcatctccagattcatcagactgatccctctcggctggcacgtgcggatcgccatcagaatggaactgctggaatgcgtgtccaagtgcgcctgacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 15 - DNA, 224 bp, Homo sapiens
ctataatgatgatcttgttctttctgtttaattttactgtccctagcttcttagcatctgcggatgtttttcctggcagatatttactcaccatgacttcttccagaaggggtgttggtagctttcatgtgactatttctatttcacttttccatgtaacgagtgatgctgttggatttctctttcattaattagattttttctgtctcatccttttgctttag

SEQ ID NO: 16 - DNA, 60 bp, Homo sapiens
gatgctgttggatttctctttcattaattagattttttctgtctcatccttttgctttag

SEQ ID NO: 17 - DNA, 183 bp, Mus musculus
gctgtactgcaccctgctttgctatattaatatattttccataattctataagaaaaaacaacagtcattgccatccttttcctccctccagaatgagctccttaatctctatggcattgttttcattttgccttctttcctttcttaatttcattttttccctctcttgttcttttgctcag

SEQ ID NO: 18 - DNA, 63 bp, Mus musculus
ttttcattttgccttctttcctttcttaatttcattttttccctctcttgttcttttgctcag

SEQ ID NO: 19 - DNA, 183 bp, Mus musculus
ctgagcaaaagaacaagagagggaaaaaatgaaattaagaaaggaaagaaggcaaaatgaaaacaatgccatagagattaaggagctcattctggagggaggaaaaggatggcaatgactgttgttttttcttatagaattatggaaaatatattaatatagcaaagcagggtgcagtacagc

SEQ ID NO: 20 - DNA, 63 bp, Mus musculus
ctgagcaaaagaacaagagagggaaaaaatgaaattaagaaaggaaagaaggcaaaatgaaaa

SEQ ID NO: 21 - DNA, 96 bp, Artificial Sequence
  Synthetic
gttgaccagctcggcggtgacctgcacgtctagggcgcagtagtccagggtttccttgatgatgtcatacttatcctgtcccttttttttccacag

SEQ ID NO: 22 - DNA, 226 bp, Artificial Sequence
  Synthetic
ctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggc

SEQ ID NO: 23 - DNA, 222 bp, Artificial Sequence
  Synthetic
cagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 24 - DNA, 222 bp, Artificial Sequence
  Synthetic
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctg

SEQ ID NO: 25 - DNA, 2094 bp, Artificial Sequence
  Synthetic
tgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagacagaaacatacagtttcctaaagcctggctttgaatgcagaagggagcagctcctcctagttaagtttccactaaatcatcgccaaagaggacttcagagccctggggaggcagctgagggtctcaagggtgactgggtggcagggatgagtgcggtgggtgagaatcccggtgccctgagaggctatacgtgacaaatgaccaaaagcccaaggtaggggagtttcctctgctcacagttcttaccttcaaggcggatctgggcttccaccctcatgaacacagggattggggagggaccagagcgcccaatacacacagctccattatgcaatccattccagcaaattccccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgccttagattgggaggcctcattggccacttagagcgcagcctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaacccagcatctttctagtccctatgctgtatgcttgaacttcggaaaatgcttttccccgcccaatcttctctcaaatataaacacatcacacagggtgttgggggtggggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtatacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagtatgtggta

SEQ ID NO: 26 - DNA, 4176 bp, Artificial Sequence
  Synthetic
atggacaagcccaagaaaaagcggaaagtgaagtacagcatcggcctggacatcggcaccaactctgtgggctgggccgtgatcaccgacgagtacaaggtgcccagcaagaaattcaaggtgctgggcaacaccgacaggcacagcatcaagaagaacctgatcggcgccctgctgttcgacagcggcgaaacagccgaggccaccagactgaagagaaccgccagaagaagatacaccaggcggaagaacaggatctgctatctgcaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctacctggccctggcccacatgatcaagttcagaggccacttcctgatcgagggcgacctgaaccccgacaacagcgacgtggacaagctgttcatccagctggtgcagacctacaaccagctgttcgaggaaaaccccatcaacgccagcggcgtggacgccaaggctatcctgtctgccagactgagcaagagcagaaggctggaaaatctgatcgcccagctgcccggcgagaagaagaacggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgttcctggccgccaagaacctgtctgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagaaatcttcttcgaccagagcaagaacggctacgccggctacatcgatggcggcgctagccaggaagagttctacaagttcatcaagcccatcctggaaaagatggacggcaccgaggaactgctcgtgaagctgaacagagaggacctgctgagaaagcagagaaccttcgacaacggcagcatcccccaccagatccacctgggagagctgcacgctatcctgagaaggcaggaagatttttacccattcctgaaggacaaccgggaaaagatcgagaagatcctgaccttcaggatcccctactacgtgggccccctggccagaggcaacagcagattcgcctggatgaccagaaagagcgaggaaaccatcaccccctggaacttcgaggaagtggtggacaagggcgccagcgcccagagcttcatcgagagaatgacaaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaggccatcgtggacctgctgttcaagaccaacagaaaagtgaccgtgaagcagctgaaagaggactacttcaagaaaatcgagtgcttcgactccgtggaaatctccggcgtggaagatagattcaacgcctccctgggcacataccacgatctgctgaaaattatcaaggacaaggacttcctggataacgaagagaacgaggacattctggaagatatcgtgctgaccctgacactgtttgaggaccgcgagatgatcgaggaaaggctgaaaacctacgctcacctgttcgacgacaaagtgatgaagcagctgaagagaaggcggtacaccggctggggcaggctgagcagaaagctgatcaacggcatcagagacaagcagagcggcaagacaatcctggatttcctgaagtccgacggcttcgccaaccggaacttcatgcagctgatccacgacgacagcctgacattcaaagaggacatccagaaagcccaggtgtccggccagggcgactctctgcacgagcatatcgctaacctggccggcagccccgctatcaagaagggcatcctgcagacagtgaaggtggtggacgagctcgtgaaagtgatgggcagacacaagcccgagaacatcgtgatcgagatggctagagagaaccagaccacccagaagggacagaagaactcccgcgagaggatgaagagaatcgaagagggcatcaaagagctgggcagccagatcctgaaagaacaccccgtggaaaacacccagctgcagaacgagaagctgtacctgtactacctgcagaatggccgggatatgtacgtggaccaggaactggacatcaacagactgtccgactacgatgtggaccatatcgtgcctcagagctttctgaaggacgactccatcgataacaaagtgctgactcggagcgacaagaacagaggcaagagcgacaacgtgccctccgaagaggtcgtgaagaagatgaagaactactggcgacagctgctgaacgccaagctgattacccagaggaagttcgataacctgaccaaggccgagagaggcggcctgagcgagctggataaggccggcttcatcaagaggcagctggtggaaaccagacagatcacaaagcacgtggcacagatcctggactcccggatgaacactaagtacgacgaaaacgataagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgaaatcaccctggccaacggcgagatcagaaagcgccctctgatcgagacaaacggcgaaaccggggagatcgtgtgggataagggcagagacttcgccacagtgcgaaaggtgctgagcatgccccaagtgaatatcgtgaaaaagaccgaggtgcagacaggcggcttcagcaaagagtctatcctgcccaagaggaacagcgacaagctgatcgccagaaagaaggactgggaccccaagaagtacggcggcttcgacagccctaccgtggcctactctgtgctggtggtggctaaggtggaaaagggcaagtccaagaaactgaagagtgtgaaagagctgctggggatcaccatcatggaaagaagcagctttgagaagaaccctatcgactttctggaagccaagggctacaaagaagtgaaaaaggacctgatcatcaagctgcctaagtactccctgttcgagctggaaaacggcagaaagagaatgctggcctctgccggcgaactgcagaagggaaacgagctggccctgcctagcaaatatgtgaacttcctgtacctggcctcccactatgagaagctgaagggcagccctgaggacaacgaacagaaacagctgtttgtggaacagcataagcactacctggacgagatcatcgagcagatcagcgagttctccaagagagtgatcctggccgacgccaatctggacaaggtgctgtctgcctacaacaagcacagggacaagcctatcagagagcaggccgagaatatcatccacctgttcaccctgacaaacctgggcgctcctgccgccttcaagtactttgacaccaccatcgaccggaagaggtacaccagcaccaaagaggtgctggacgccaccctgatccaccagagcatcaccggcctgtacgagacaagaatcgacctgtctcagctgggaggcgacaagagacctgccgccactaagaaggccggacaggccaaaaagaagaagtga

SEQ ID NO: 27 - protein, 1391 aa, Artificial Sequence
  Synthetic
MDKPKKKRKVKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 28 - DNA, 4218 bp, Artificial Sequence
  Synthetic
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctacctggccctggcccacatgatcaagttcagaggccacttcctgatcgagggcgacctgaaccccgacaacagcgacgtggacaagctgttcatccagctggtgcagacctacaaccagctgttcgaggaaaaccccatcaacgccagcggcgtggacgccaaggctatcctgtctgccagactgagcaagagcagaaggctggaaaatctgatcgcccagctgcccggcgagaagaagaacggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgttcctggccgccaagaacctgtctgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagaaatcttcttcgaccagagcaagaacggctacgccggctacatcgatggcggcgctagccaggaagagttctacaagttcatcaagcccatcctggaaaagatggacggcaccgaggaactgctcgtgaagctgaacagagaggacctgctgagaaagcagagaaccttcgacaacggcagcatcccccaccagatccacctgggagagctgcacgctatcctgagaaggcaggaagatttttacccattcctgaaggacaaccgggaaaagatcgagaagatcctgaccttcaggatcccctactacgtgggccccctggccagaggcaacagcagattcgcctggatgaccagaaagagcgaggaaaccatcaccccctggaacttcgaggaagtggtggacaagggcgccagcgcccagagcttcatcgagagaatgacaaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaggccatcgtggacctgctgttcaagaccaacagaaaagtgaccgtgaagcagctgaaagaggactacttcaagaaaatcgagtgcttcgactccgtggaaatctccggcgtggaagatagattcaacgcctccctgggcacataccacgatctgctgaaaattatcaaggacaaggacttcctggataacgaagagaacgaggacattctggaagatatcgtgctgaccctgacactgtttgaggaccgcgagatgatcgaggaaaggctgaaaacctacgctcacctgttcgacgacaaagtgatgaagcagctgaagagaaggcggtacaccggctggggcaggctgagcagaaagctgatcaacggcatcagagacaagcagagcggcaagacaatcctggatttcctgaagtccgacggcttcgccaaccggaacttcatgcagctgatccacgacgacagcctgacattcaaagaggacatccagaaagcccaggtgtccggccagggcgactctctgcacgagcatatcgctaacctggccggcagccccgctatcaagaagggcatcctgcagacagtgaaggtggtggacgagctcgtgaaagtgatgggcagacacaagcccgagaacatcgtgatcgagatggctagagagaaccagaccacccagaagggacagaagaactcccgcgagaggatgaagagaatcgaagagggcatcaaagagctgggcagccagatcctgaaagaacaccccgtggaaaacacccagctgcagaacgagaagctgtacctgtactacctgcagaatggccgggatatgtacgtggaccaggaactggacatcaacagactgtccgactacgatgtggaccatatcgtgcctcagagctttctgaaggacgactccatcgataacaaagtgctgactcggagcgacaagaacagaggcaagagcgacaacgtgccctccgaagaggtcgtgaagaagatgaagaactactggcgacagctgctgaacgccaagctgattacccagaggaagttcgataacctgaccaaggccgagagaggcggcctgagcgagctggataaggccggcttcatcaagaggcagctggtggaaaccagacagatcacaaagcacgtggcacagatcctggactcccggatgaacactaagtacgacgaaaacgataagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgaaatcaccctggccaacggcgagatcagaaagcgccctctgatcgagacaaacggcgaaaccggggagatcgtgtgggataagggcagagacttcgccacagtgcgaaaggtgctgagcatgccccaagtgaatatcgtgaaaaagaccgaggtgcagacaggcggcttcagcaaagagtctatcctgcccaagaggaacagcgacaagctgatcgccagaaagaaggactgggaccccaagaagtacggcggcttcgacagccctaccgtggcctactctgtgctggtggtggctaaggtggaaaagggcaagtccaagaaactgaagagtgtgaaagagctgctggggatcaccatcatggaaagaagcagctttgagaagaaccctatcgactttctggaagccaagggctacaaagaagtgaaaaaggacctgatcatcaagctgcctaagtactccctgttcgagctggaaaacggcagaaagagaatgctggcctctgccggcgaactgcagaagggaaacgagctggccctgcctagcaaatatgtgaacttcctgtacctggcctcccactatgagaagctgaagggcagccctgaggacaacgaacagaaacagctgtttgtggaacagcataagcactacctggacgagatcatcgagcagatcagcgagttctccaagagagtgatcctggccgacgccaatctggacaaggtgctgtctgcctacaacaagcacagggacaagcctatcagagagcaggccgagaatatcatccacctgttcaccctgacaaacctgggcgctcctgccgccttcaagtactttgacaccaccatcgaccggaagaggtacaccagcaccaaagaggtgctggacgccaccctgatccaccagagcatcaccggcctgtacgagacaagaatcgacctgtctcagctgggaggcgacaagagacctgccgccactaagaaggccggacaggccaaaaagaagaagtgagcggccgcttaatta

SEQ ID NO: 29 - RNA, 16 nt, Artificial Sequence
  Synthetic
guuuuagagcuaugcu

SEQ ID NO: 30 - RNA, 67 nt, Artificial Sequence
  Synthetic
agcauagcaaguuaaaauaaggcuaguccguuaucaacuugaaaaaguggcaccgagucggugcuuu

SEQ ID NO: 31 - RNA, 72 nt, Artificial Sequence
  Synthetic
aaacagcauagcaaguuaaaauaaggcuaguccguuaucaacuugaaaaaguggcaccgagucggugcuuuu

SEQ ID NO: 32 - RNA, 82 nt, Artificial Sequence
  Synthetic
guuggaaccauucaaaacagcauagcaaguuaaaauaaggcuaguccguuaucaacuugaaaaaguggcaccgagucggugc

SEQ ID NO: 33 - RNA, 77 nt, Artificial Sequence
  Synthetic
guuuuagagcuagaaauagcaaguuaaaauaaggcuaguccguuaucaacuugaaaaaguggcaccgagucggugcu

SEQ ID NO: 34 - RNA, 82 nt, Artificial Sequence; identical to SEQ ID NO: 32
  Synthetic

SEQ ID NO: 35 - RNA, 76 nt, Artificial Sequence
  Synthetic
guuuuagagcuagaaauagcaaguuaaaauaaggcuaguccguuaucaacuugaaaaaguggcaccgagucggugc

SEQ ID NO: 36 - RNA, 86 nt, Artificial Sequence
  Synthetic
guuuaagagcuaugcuggaaacagcauagcaaguuuaaauaaggcuaguccguuaucaacuugaaaaaguggcaccgagucggugc

SEQ ID NO: 37 - RNA, 83 nt, Artificial Sequence
  Synthetic
guuuuagagcuagaaauagcaaguuaaaauaaggcuaguccguuaucaacuugaaaaaguggcaccgagucggugcuuuuuuu

SEQ ID NO: 38 - RNA, 80 nt, Artificial Sequence
  Synthetic
guuuuagagcuagaaauagcaaguuaaaauaaggcuaguccguuaucaacuugaaaaaguggcaccgagucggugcuuuu

SEQ ID NO: 39 - RNA, 92 nt, Artificial Sequence
  Synthetic
guuuaagagcuaugcuggaaacagcauagcaaguuuaaauaaggcuaguccguuaucaacuugaaaaaguggcaccgagucggugcuuuuuu

SEQ ID NO: 40 - DNA, 23 bp, Artificial Sequence
  Synthetic
  misc_feature (2)..(21): n is a, c, g, or t
gnnnnnnnnnnnnnnnnnnnngg

SEQ ID NO: 41 - DNA, 23 bp, Artificial Sequence
  Synthetic
  misc_feature (1)..(21): n is a, c, g, or t
nnnnnnnnnnnnnnnnnnnnngg

SEQ ID NO: 42 - DNA, 25 bp, Artificial Sequence
  Synthetic
  misc_feature (3)..(23): n is a, c, g, or t
ggnnnnnnnnnnnnnnnnnnnnngg

SEQ ID NO: 43 - RNA, 103 nt, Artificial Sequence
  Synthetic
gagcacggaacgaccugaguguuuuagagcuagaaauagcaaguuaaaauaaggcuaguccguuaucaacuugaaaaaguggcaccgagucggugcuuuuuuu

SEQ ID NO: 44 - RNA, 100 nt, Artificial Sequence
  Synthetic
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 45 - DNA, 3519 bp, Artificial Sequence
  Synthetic
  misc_feature (1)..(141): ITR
  misc_feature (156)..(178): Guide RNA Target Sequence Plus PAM
  misc_feature (179)..(274): Splice Acceptor
  misc_feature (275)..(897): Human RS1
  misc_feature (898)..(2991): Human RS1 PolyA Region
  misc_feature (2992)..(3240): U6
  misc_feature (3241)..(3260): Guide Sequence
  misc_feature (3261)..(3343): Guide RNA Scaffold
  misc_feature (3344)..(3366): Guide RNA Target Sequence Plus PAM
  misc_feature (3379)..(3519): ITR
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcgctagctgtacacctactcaggtcgttccgtgctcgttgaccagctcggcggtgacctgcacgtctagggcgcagtagtccagggtttccttgatgatgtcatacttatcctgtcccttttttttccacagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagacagaaacatacagtttcctaaagcctggctttgaatgcagaagggagcagctcctcctagttaagtttccactaaatcatcgccaaagaggacttcagagccctggggaggcagctgagggtctcaagggtgactgggtggcagggatgagtgcggtgggtgagaatcccggtgccctgagaggctatacgtgacaaatgaccaaaagcccaaggtaggggagtttcctctgctcacagttcttaccttcaaggcggatctgggcttccaccctcatgaacacagggattggggagggaccagagcgcccaatacacacagctccattatgcaatccattccagcaaattccccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgccttagattgggaggcctcattggccacttagagcgcagcctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaacccagcatctttctagtccctatgctgtatgcttgaacttcggaaaatgcttttccccgcccaatcttctctcaaatataaacacatcacacagggtgttgggggtggggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtatacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagtatgtggtagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagcacggaacgacctgagtgttttagagctagaaatagcaagttaaaataaggctagtccgttatcaacttgaaaaagtggcaccgagtcggtgctttttttcctactcaggtcgttccgtgctctctagaggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 46 - DNA, 2455 bp, Artificial Sequence
  Synthetic
  misc_feature (1)..(161): ITR
  misc_feature (168)..(227): Splice Acceptor
  misc_feature (228)..(850): Human RS1
  misc_feature (851)..(1076): bGH polyA
  misc_feature (1077)..(1325): U6
  misc_feature (1326)..(1345): Guide Sequence
  misc_feature (1346)..(1428): Guide RNA Scaffold
  misc_feature (1429)..(1650): Reverse Complement of SV40 polyA
  misc_feature (1651)..(2273): Reverse Complement of Codon-Optimized hRS1
  misc_feature (2274)..(2336): Reverse Complement of Splice Acceptor
  misc_feature (2344)..(2455): ITR
ggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacctagggatgctgttggatttctctttcattaattagattttttctgtctcatccttttgctttagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagcacggaacgacctgagtgttttagagctagaaatagcaagttaaaataaggctagtccgttatcaacttgaaaaagtggcaccgagtcggtgcttttttttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgtcaggcgcacttggacacgcattccagcagttccattctgatggcgatccgcacgtgccagccgagagggatcagtctgatgaatctggagatgataggaggcctcagcagattctgcacggtgctggttctgtcgctgttgccgtagaacactctgttgttgccggtctggtccttgtagtagatccagttcagtctctcgtcggttctgtactgcacgctgtacttggtcatccactcgtcgatgtcgcatctgccctgtgtcaggatgccgctgatgactttgatctctttcaggtcgatctgcagccactggctagagtcctggaacttgctcagccaggcacagccgaagccttggctgttcagtctggccttgttggctgtccagctagagtaccagccgacgtactgctcggggttgctacaggtgatctggtcaggggtcacttcgccgctctcgaagcccagaggcttatggtaggggcactcagggatgcagtccaggcttgtagcgccagcgctccaaagagcattagggccgccttgacagtcgcacttgcaggctttctgataccaggggtcctcgccttcatcttctgtgctgctcaggcccagtgtggctgagcaaaagaacaagagagggaaaaaatgaaattaagaaaggaaagaaggcaaaatgaaaagctagtccactccctctctgcgcgctcgctcgctcactgaggccgggcgaccaaaggtcgcccgacgcccgggctttgcccgggcggcctcagtgagcgagcgagcgcgcagagaggga

SEQ ID NO: 47 - DNA, 2763 bp, Artificial Sequence
  Synthetic
  misc_feature (1)..(141): ITR
  misc_feature (156)..(379): Splice Acceptor
  misc_feature (380)..(1002): Human RS1
  misc_feature (1003)..(1228): bGH polyA
  misc_feature (1229)..(1477): U6
  misc_feature (1478)..(1497): Guide Sequence
  misc_feature (1498)..(1574): Guide RNA Scaffold
  misc_feature (1575)..(1802): Reverse Complement of SV40 polyA
  misc_feature (1803)..(2425): Reverse Complement of Codon-Optimized Human RS1
  misc_feature (2426)..(2608): Splice Acceptor
  misc_feature (2609)..(2763): ITR
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcgctagctgtacactataatgatgatcttgttctttctgtttaattttactgtccctagcttcttagcatctgcggatgtttttcctggcagatatttactcaccatgacttcttccagaaggggtgttggtagctttcatgtgactatttctatttcacttttccatgtaacgagtgatgctgttggatttctctttcattaattagattttttctgtctcatccttttgctttagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagcacggaacgacctgagtgttttagagctagaaatagcaagttaaaataaggctagtccgttatcaacttgaaaaagtggcaccgagtcggtgcttttttttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgtcaggcgcacttggacacgcattccagcagttccattctgatggcgatccgcacgtgccagccgagagggatcagtctgatgaatctggagatgataggaggcctcagcagattctgcacggtgctggttctgtcgctgttgccgtagaacactctgttgttgccggtctggtccttgtagtagatccagttcagtctctcgtcggttctgtactgcacgctgtacttggtcatccactcgtcgatgtcgcatctgccctgtgtcaggatgccgctgatgactttgatctctttcaggtcgatctgcagccactggctagagtcctggaacttgctcagccaggcacagccgaagccttggctgttcagtctggccttgttggctgtccagctagagtaccagccgacgtactgctcggggttgctacaggtgatctggtcaggggtcacttcgccgctctcgaagcccagaggcttatggtaggggcactcagggatgcagtccaggcttgtagcgccagcgctccaaagagcattagggccgccttgacagtcgcacttgcaggctttctgataccaggggtcctcgccttcatcttctgtgctgctcaggcccagtgtggctgagcaaaagaacaagagagggaaaaaatgaaattaagaaaggaaagaaggcaaaatgaaaacaatgccatagagattaaggagctcattctggagggaggaaaaggatggcaatgactgttgttttttcttatagaattatggaaaatatattaatatagcaaagcagggtgcagtacagccctctagaggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 48 - protein, 224 aa, Mus musculus
MPHKIEGFFLLLLFGYEATLGLSSTEDEGEDPWYQKACKCDCQVGANALWSAGATSLDCIPECPYHKPLGFESGEVTPDQITCSNPEQYVGWYSSWTANKARLNSQGFGCAWLSKYQDSSQWLQIDLKEIKVISGILTQGCCDIDEWVTKYSVQYRTDERLNWIYYKDQTGNNRVFYGNSDRSSTVQNLLRPPIISRFIRLIPLGWHVRIAIRMELLECASKCA

SEQ ID NO: 49 - protein, 7 aa, Artificial Sequence
  Synthetic
PKKKRKV

SEQ ID NO: 50 - protein, 7 aa, Artificial Sequence
  Synthetic
PKKKRRV

SEQ ID NO: 51 - protein, 16 aa, Artificial Sequence
  Synthetic
KRPAATKKAGQAKKKK

SEQ ID NO: 52 - RNA, 22 nt, Artificial Sequence
  Synthetic
guuuuagagcuaugcuguuuug

SEQ ID NO: 53 - RNA, 68 nt, Artificial Sequence
  Synthetic
guuuuagagcuagaaauagcaaguuaaaauaaggcuaguccguuaucaacuuggcaccgagucggugc

SEQ ID NO: 54 - DNA, 20 bp, Artificial Sequence
  Synthetic
gggccttatgcatctccatc

SEQ ID NO: 55 - DNA, 20 bp, Artificial Sequence
  Synthetic
taatcagcatattatccaga

SEQ ID NO: 56 - DNA, 20 bp, Artificial Sequence
  Synthetic
cccttttgtacgttttttaa

SEQ ID NO: 57 - DNA, 20 bp, Artificial Sequence
  Synthetic
ctgtatcttcttagccagta

SEQ ID NO: 58 - DNA, 20 bp, Artificial Sequence
  Synthetic
gttaacgcgtcatttacatt

SEQ ID NO: 59 - DNA, 20 bp, Artificial Sequence
  Synthetic
tacaataaattagccggatg

SEQ ID NO: 60 - DNA, 20 bp, Artificial Sequence
  Synthetic
aaacttttaggagtcaaagt

SEQ ID NO: 61 - DNA, 20 bp, Artificial Sequence
  Synthetic
aaaacttttaggagtcaaag

SEQ ID NO: 62 - DNA, 20 bp, Artificial Sequence
  Synthetic
aatgttaacagtgttggctt

SEQ ID NO: 63 - DNA, 20 bp, Artificial Sequence
  Synthetic
gtggtggctgcaggtgaggg

SEQ ID NO: 64 - DNA, 20 bp, Artificial Sequence
  Synthetic
tactaaaatgttaacagtgt

SEQ ID NO: 65 - DNA, 20 bp, Artificial Sequence
  Synthetic
aaaaaaggacttgacatgca

SEQ ID NO: 66 - DNA, 20 bp, Artificial Sequence
  Synthetic
gtcccagcttctcttgaggg

SEQ ID NO: 67 - DNA, 20 bp, Artificial Sequence
  Synthetic
gttaacagtgttggctttgg

SEQ ID NO: 68 - DNA, 20 bp, Artificial Sequence
  Synthetic
gttggtggtcactgacagtg

SEQ ID NO: 69 - DNA, 20 bp, Artificial Sequence
  Synthetic
gaaactagtggctaccgtac

SEQ ID NO: 70 - DNA, 20 bp, Artificial Sequence
  Synthetic
aaaaaacgtacaaaaggggc

SEQ ID NO: 71 - DNA, 20 bp, Artificial Sequence
  Synthetic
agccccaggccatcaaccgg

SEQ ID NO: 72 - DNA, 20 bp, Artificial Sequence
  Synthetic
ggcagccagacagatgcttc

SEQ ID NO: 73 - DNA, 20 bp, Artificial Sequence
  Synthetic
ctggagaacaaaagcatttt

SEQ ID NO: 74 - DNA, 20 bp, Artificial Sequence
  Synthetic
atcttagatttatgcaatgt

SEQ ID NO: 75 - DNA, 20 bp, Artificial Sequence
  Synthetic
acaagtagaatcagaattct

SEQ ID NO: 76 - DNA, 20 bp, Artificial Sequence
  Synthetic
aatatcggctcactgcaacc

SEQ ID NO: 77 - DNA, 20 bp, Artificial Sequence
  Synthetic
ccctcaagagaagctgggac

SEQ ID NO: 78 - DNA, 20 bp, Artificial Sequence
  Synthetic
tcttaggagatgacgaggtt

SEQ ID NO: 79 - DNA, 20 bp, Artificial Sequence
  Synthetic
aataataaagaactagagaa

SEQ ID NO: 80 - DNA, 20 bp, Artificial Sequence
  Synthetic
aaaaacgtacaaaaggggcc

SEQ ID NO: 81 - DNA, 20 bp, Artificial Sequence
  Synthetic
ggctgagcaggcggagaagt

SEQ ID NO: 82 - DNA, 20 bp, Artificial Sequence
  Synthetic
agagaaaggagaacagtctg

SEQ ID NO: 83 - DNA, 20 bp, Artificial Sequence
  Synthetic
cttctttctctttcacgaga

SEQ ID NO: 84 - DNA, 20 bp, Artificial Sequence
  Synthetic
aatcttagatttatgcaatg

SEQ ID NO: 85 - DNA, 20 bp, Artificial Sequence
  Synthetic
ctgagcaggcggagaagtag

SEQ ID NO: 86 - DNA, 20 bp, Artificial Sequence
  Synthetic
acctagtgttgacaaggctg

SEQ ID NO: 87 - DNA, 20 bp, Artificial Sequence
  Synthetic
tcccagcttctcttgagggt

SEQ ID NO: 88 - DNA, 20 bp, Artificial Sequence
  Synthetic
aataattctgttgggacgac

SEQ ID NO: 89 - DNA, 20 bp, Artificial Sequence
  Synthetic
cctataaagaggacgtttcc

SEQ ID NO: 90 - DNA, 20 bp, Artificial Sequence
  Synthetic
ccttctttctctttcacgag

SEQ ID NO: 91 - DNA, 20 bp, Artificial Sequence
  Synthetic
cccatcgaagtactcaccat

SEQ ID NO: 92 - DNA, 20 bp, Artificial Sequence
  Synthetic
gtgtcatatgttgctggtgg

SEQ ID NO: 93 - DNA, 20 bp, Artificial Sequence
  Synthetic
aatgtaaatgacgcgttaac

SEQ ID NO: 94 - DNA, 20 bp, Artificial Sequence
  Synthetic
gcctttgagccaagtggatt

SEQ ID NO: 95 - DNA, 20 bp, Artificial Sequence
  Synthetic
gtcagactctgtgctggctg

SEQ ID NO: 96 - DNA, 20 bp, Artificial Sequence
  Synthetic
ccgtcaatagcattccggtt

SEQ ID NO: 97 - DNA, 20 bp, Artificial Sequence
  Synthetic
ccattaaaaaacgtacaaaa

SEQ ID NO: 98 - DNA, 20 bp, Artificial Sequence
  Synthetic
gggatttggggaggatgggg

SEQ ID NO: 99 - DNA, 20 bp, Artificial Sequence
  Synthetic
actgtgtcatatgttgctgg

SEQ ID NO: 100 - DNA, 20 bp, Artificial Sequence
  Synthetic
tacaatgttgtggaccgggc

SEQ ID NO: 101 - DNA, 20 bp, Artificial Sequence
  Synthetic
gatagagtagcaaacaaaac

SEQ ID NO: 102 - DNA, 20 bp, Artificial Sequence
  Synthetic
gctctcaaaggagactgaga

SEQ ID NO: 103 - DNA, 20 bp, Artificial Sequence
  Synthetic
ggaagagcaaggagctcctg

SEQ ID NO: 104 - DNA, 20 bp, Artificial Sequence
  Synthetic
tgtgtcatatgttgctggtg

SEQ ID NO: 105 - DNA, 20 bp, Artificial Sequence
  Synthetic
ctgagaaggtgtacctagag

SEQ ID NO: 106 - DNA, 20 bp, Artificial Sequence
  Synthetic
gtccgggagccagttcctgc

SEQ ID NO: 107 - DNA, 20 bp, Artificial Sequence
  Synthetic
ttaggagatgacgaggttgg

SEQ ID NO: 108 - DNA, 20 bp, Artificial Sequence
  Synthetic
ggaggaagcagagctctcaa

SEQ ID NO: 109 - DNA, 20 bp, Artificial Sequence
  Synthetic
agtcatcagcctgggaaaca

SEQ ID NO: 110 - DNA, 20 bp, Artificial Sequence
  Synthetic
tccgggagccagttcctgca

SEQ ID NO: 111 - DNA, 20 bp, Artificial Sequence
  Synthetic
gagcaaggagctcctgaggc

SEQ ID NO: 112 - DNA, 20 bp, Artificial Sequence
  Synthetic
tctggtacaatgttgtggac

SEQ ID NO: 113 - DNA, 20 bp, Artificial Sequence
  Synthetic
cctgggagtgtctgacaacc

SEQ ID NO: 114 - DNA, 20 bp, Artificial Sequence
  Synthetic
ccagttcctgcagggcctcg

SEQ ID NO: 115 - DNA, 20 bp, Artificial Sequence
  Synthetic
tagggaatgggctgagcagg

SEQ ID NO: 116 - DNA, 20 bp, Artificial Sequence
  Synthetic
agctttctgtccctgtgaga

SEQ ID NO: 117 - DNA, 20 bp, Artificial Sequence
  Synthetic
tcgtctccctgccttctcac

SEQ ID NO: 118 - DNA, 20 bp, Artificial Sequence
  Synthetic
cgaagtactcaccatgggca

SEQ ID NO: 119 - DNA, 20 bp, Artificial Sequence
  Synthetic
aggccactggaccatgccca

SEQ ID NO: 120 - DNA, 20 bp, Artificial Sequence
  Synthetic
ggcagggagacgagtctaat

SEQ ID NO: 121 - DNA, 20 bp, Artificial Sequence
  Synthetic
gggcttagatttatgcaata

SEQ ID NO: 122 - DNA, 20 bp, Artificial Sequence
  Synthetic
ttcagcgaagacaagggatt

SEQ ID NO: 123 - DNA, 20 bp, Artificial Sequence
  Synthetic
catggcccacgaggccctgc

SEQ ID NO: 124 - DNA, 20 bp, Artificial Sequence
  Synthetic
cagttcctgcagggcctcgt

SEQ ID NO: 125 - DNA, 20 bp, Artificial Sequence
  Synthetic
cattaaaaaacgtacaaaag

SEQ ID NO: 126 - DNA, 20 bp, Artificial Sequence
  Synthetic
aggcagggagacgagtctaa

SEQ ID NO: 127 - DNA, 20 bp, Artificial Sequence
  Synthetic
ctaacatctggatgaacctg

SEQ ID NO: 128 - DNA, 20 bp, Artificial Sequence
  Synthetic
ccagtggcctgtcttctcct

SEQ ID NO: 129 - DNA, 20 bp, Artificial Sequence
  Synthetic
tattacaaatactgccgcta

SEQ ID NO: 130 - DNA, 20 bp, Artificial Sequence
  Synthetic
gcagggagacgagtctaatg

SEQ ID NO: 131 - DNA, 20 bp, Artificial Sequence
  Synthetic
caatctgcttgagaaacagg

SEQ ID NO: 132 - DNA, 20 bp, Artificial Sequence
  Synthetic
ggcttagatttatgcaatat

SEQ ID NO: 133 - DNA, 20 bp, Artificial Sequence
  Synthetic
acactcccagggctcactct

SEQ ID NO: 134 - DNA, 20 bp, Artificial Sequence
  Synthetic
tatgggctcattctgcccct

SEQ ID NO: 135 - DNA, 20 bp, Artificial Sequence
  Synthetic
cgaagacaagggatttgggg

SEQ ID NO: 136 - DNA, 20 bp, Artificial Sequence
  Synthetic
agcacagagtctgacattga

SEQ ID NO: 137 - DNA, 20 bp, Artificial Sequence
  Synthetic
gtcttaggagatgacgaggt

SEQ ID NO: 138 - DNA, 20 bp, Artificial Sequence
  Synthetic
gctgagcaggcggagaagta

SEQ ID NO: 139 - DNA, 20 bp, Artificial Sequence
  Synthetic
ttccaatctgcttgagaaac

SEQ ID NO: 140 - DNA, 20 bp, Artificial Sequence
  Synthetic
gagatcataatacatctcag

SEQ ID NO: 141 - DNA, 20 bp, Artificial Sequence
  Synthetic
gcccatcgaagtactcacca

SEQ ID NO: 142 - DNA, 20 bp, Artificial Sequence
  Synthetic
caggcggagaagtaggggtg

SEQ ID NO: 143 - DNA, 20 bp, Artificial Sequence
  Synthetic
ttgaaacccagtcaccaatg

SEQ ID NO: 144 - DNA, 20 bp, Artificial Sequence
  Synthetic
acataatccaactgagagtc

SEQ ID NO: 145 - DNA, 20 bp, Artificial Sequence
  Synthetic
gtgagtgtactgagtctccg

SEQ ID NO: 146 - DNA, 20 bp, Artificial Sequence
  Synthetic
caatggagtcacacagcatg

SEQ ID NO: 147 - DNA, 20 bp, Artificial Sequence
  Synthetic
ggggtggggggacgcatttg

SEQ ID NO: 148 - DNA, 20 bp, Artificial Sequence
  Synthetic
aactgagagtcaggaaacct

SEQ ID NO: 149 - DNA, 20 bp, Artificial Sequence
  Synthetic
tgctcacttccataaggata

SEQ ID NO: 150 - DNA, 20 bp, Artificial Sequence
  Synthetic
atttggggaggatggggagg

SEQ ID NO: 151 - DNA, 20 bp, Artificial Sequence
  Synthetic
cgggctggccacggcaagtg

SEQ ID NO: 152 - DNA, 20 bp, Artificial Sequence
  Synthetic
ctcaatgtcagactctgtgc

SEQ ID NO: 153 - DNA, 20 bp, Artificial Sequence
  Synthetic
tgcagactattaattgcaag

SEQ ID NO: 154 - DNA, 20 bp, Artificial Sequence
  Synthetic
acaggcgtgagccacgggcc

SEQ ID NO: 155 - DNA, 20 bp, Artificial Sequence
  Synthetic
catcaattgtgccaggcccg

SEQ ID NO: 156 - DNA, 20 bp, Artificial Sequence
  Synthetic
cagcacagagtctgacattg

SEQ ID NO: 157 - DNA, 20 bp, Artificial Sequence
  Synthetic
gttgcagactattaattgca

SEQ ID NO: 158 - DNA, 20 bp, Artificial Sequence
  Synthetic
gcaagtgtggcaacagggtc

SEQ ID NO: 159 - DNA, 20 bp, Artificial Sequence
  Synthetic
tagggtcttggagttttgat

SEQ ID NO: 160 - DNA, 20 bp, Artificial Sequence
  Synthetic
aaagcctcacatggcccacg

SEQ ID NO: 161 - DNA, 20 bp, Artificial Sequence
  Synthetic
cctcgaggtgagcgtgtgct

SEQ ID NO: 162 - DNA, 20 bp, Artificial Sequence
  Synthetic
gcaggcggagaagtaggggt

SEQ ID NO: 163 - DNA, 20 bp, Artificial Sequence
  Synthetic
catttttgtggacagttgtg

SEQ ID NO: 164 - DNA, 20 bp, Artificial Sequence
  Synthetic
ttgcagactattaattgcaa

SEQ ID NO: 165 - DNA, 20 bp, Artificial Sequence
  Synthetic
ctggttgtcagacactccca

SEQ ID NO: 166 - DNA, 20 bp, Artificial Sequence
  Synthetic
cagcgaagacaagggatttg

SEQ ID NO: 167 - DNA, 20 bp, Artificial Sequence
  Synthetic
tcagcgaagacaagggattt

SEQ ID NO: 168 - DNA, 20 bp, Artificial Sequence
  Synthetic
tggatttgaaaataagaagt

SEQ ID NO: 169 - DNA, 20 bp, Artificial Sequence
  Synthetic
aggtttaaaaatattgggtg

SEQ ID NO: 170 - DNA, 20 bp, Artificial Sequence
  Synthetic
ttggcccagggtggtggcag

SEQ ID NO: 171 - DNA, 20 bp, Artificial Sequence
  Synthetic
acagaaaaagctgtcaccaa

SEQ ID NO: 172 - DNA, 20 bp, Artificial Sequence
  Synthetic
acaagggatttggggaggat

SEQ ID NO: 173 - DNA, 20 bp, Artificial Sequence
  Synthetic
ggcagccccaggccatcaac

SEQ ID NO: 174 - DNA, 20 bp, Artificial Sequence
  Synthetic
caggttcccagctgtacaat

SEQ ID NO: 175 - DNA, 20 bp, Artificial Sequence
  Synthetic
aggcggagaagtaggggtgg

SEQ ID NO: 176 - DNA, 20 bp, Artificial Sequence
  Synthetic
agtgtggtggctgcaggtga

SEQ ID NO: 177 - DNA, 20 bp, Artificial Sequence
  Synthetic
agcacattgggcagacacaa

SEQ ID NO: 178 - DNA, 20 bp, Artificial Sequence
  Synthetic
ccacgaggccctgcaggaac

SEQ ID NO: 179 - DNA, 20 bp, Artificial Sequence
  Synthetic
cgtctccctgccttctcaca

SEQ ID NO: 180 - DNA, 20 bp, Artificial Sequence
  Synthetic
agatactaatcccatgtatg

SEQ ID NO: 181 - DNA, 20 bp, Artificial Sequence
  Synthetic
ttaggctttgccctcataca

SEQ ID NO: 182 - DNA, 20 bp, Artificial Sequence
  Synthetic
ctactcgggggaggctgaag

SEQ ID NO: 183 - DNA, 20 bp, Artificial Sequence
  Synthetic
acctcactgcctcagcagcg

SEQ ID NO: 184 - DNA, 20 bp, Artificial Sequence
  Synthetic
ttgaggacccaggagaagac

SEQ ID NO: 185 - DNA, 20 bp, Artificial Sequence
  Synthetic
cttaggagatgacgaggttg

SEQ ID NO: 186 - DNA, 20 bp, Artificial Sequence
  Synthetic
ggcggagaagtaggggtggg

SEQ ID NO: 187 - DNA, 20 bp, Artificial Sequence
  Synthetic
ctggtacaatgttgtggacc

SEQ ID NO: 188 - DNA, 20 bp, Artificial Sequence
  Synthetic
ggcaaagcattctgggcaga

SEQ ID NO: 189 - DNA, 20 bp, Artificial Sequence
  Synthetic
gaaaattacggtgactgctg

SEQ ID NO: 190 - DNA, 20 bp, Artificial Sequence
  Synthetic
ggaccaacctagtgttgaca

SEQ ID NO: 191 - DNA, 20 bp, Artificial Sequence
  Synthetic
gcttttgttctccagtttgt

SEQ ID NO: 192 - DNA, 20 bp, Artificial Sequence
  Synthetic
tgatttaatcaccaacaaac

SEQ ID NO: 193 - DNA, 20 bp, Artificial Sequence
  Synthetic
atttagcaatgtttactggg

SEQ ID NO: 194 - DNA, 20 bp, Artificial Sequence
  Synthetic
ggcattgaatccaatatgtg

SEQ ID NO: 195 - DNA, 20 bp, Artificial Sequence
  Synthetic
gtgttaccatcagagattgc

SEQ ID NO: 196 - DNA, 20 bp, Artificial Sequence
  Synthetic
gtaggccattcagtgcttac

SEQ ID NO: 197 - DNA, 20 bp, Artificial Sequence
  Synthetic
tttgaaaataagaagttggc

SEQ ID NO: 198 - DNA, 20 bp, Artificial Sequence
  Synthetic
cacctcgttccgccggttga

SEQ ID NO: 199 - DNA, 20 bp, Artificial Sequence
  Synthetic
acacgctcacctcgagggct

SEQ ID NO: 200 - DNA, 20 bp, Artificial Sequence
  Synthetic
gatatccagtaagcactgaa

SEQ ID NO: 201 - DNA, 20 bp, Artificial Sequence
  Synthetic
tggatttagcaatgtttact

SEQ ID NO: 202 - DNA, 20 bp, Artificial Sequence
  Synthetic
taaagaggacgtttcctggc

SEQ ID NO: 203 - DNA, 20 bp, Artificial Sequence
  Synthetic
ttaatctgtcttttgtcgta

SEQ ID NO: 204 - DNA, 20 bp, Artificial Sequence
  Synthetic
ataggaaatgccttactgtg

SEQ ID NO: 205 - DNA, 20 bp, Artificial Sequence
  Synthetic
cttactggatatctgaacct

SEQ ID NO: 206 - DNA, 20 bp, Artificial Sequence
  Synthetic
agtaaacattgctaaatcca

SEQ ID NO: 207 - DNA, 20 bp, Artificial Sequence
  Synthetic
gggttcttgccttggggtat

SEQ ID NO: 208 - DNA, 20 bp, Artificial Sequence
  Synthetic
gtgaggctttgtggaacttg

SEQ ID NO: 209 - DNA, 20 bp, Artificial Sequence
  Synthetic
acatcttactactaccacat

SEQ ID NO: 210 - DNA, 20 bp, Artificial Sequence
  Synthetic
ccaccaacaccccttgcctt

SEQ ID NO: 211 - DNA, 20 bp, Artificial Sequence
  Synthetic
tttttgggagaccaaaggca

SEQ ID NO: 212 - DNA, 20 bp, Artificial Sequence
  Synthetic
tttcatcctccacgctgctg

SEQ ID NO: 213 - DNA, 20 bp, Artificial Sequence
  Synthetic
tcagagccacatgaaactag

SEQ ID NO: 214 - DNA, 20 bp, Artificial Sequence
  Synthetic
tccattaaaaaacgtacaaa

SEQ ID NO: 215 - DNA, 20 bp, Artificial Sequence
  Synthetic
aaaaaaaggacttgacatgc

SEQ ID NO: 216 - DNA, 20 bp, Artificial Sequence
  Synthetic
gctcctgaggctggagctag

SEQ ID NO: 217 - DNA, 20 bp, Artificial Sequence
  Synthetic
agaaggtgtacctagagtgg

SEQ ID NO: 218 - DNA, 20 bp, Artificial Sequence
  Synthetic
ggtgccagcagatttgggtc

SEQ ID NO: 219 - DNA, 20 bp, Artificial Sequence
  Synthetic
gatactaatcccatgtatga

SEQ ID NO: 220 - DNA, 20 bp, Artificial Sequence
  Synthetic
gaaatccgagagtgagccct

SEQ ID NO: 221 - DNA, 20 bp, Artificial Sequence
  Synthetic
aaaacccctgcaatctctga

SEQ ID NO: 222 - DNA, 20 bp, Artificial Sequence
  Synthetic
taataatatttatattattc

SEQ ID NO: 223 - DNA, 20 bp, Artificial Sequence
  Synthetic
agaaaagaaatgcaagaaat

SEQ ID NO: 224 - DNA, 20 bp, Artificial Sequence
  Synthetic
tgaactgtgtcatatgttgc

SEQ ID NO: 225 - DNA, 20 bp, Artificial Sequence
  Synthetic
cagaaagctttctgtatctc

SEQ ID NO: 226 - DNA, 20 bp, Artificial Sequence
  Synthetic
agaagctgggactggctgtg

SEQ ID NO: 227 - DNA, 20 bp, Artificial Sequence
  Synthetic
cttctcttgagggtggggat

SEQ ID NO: 228 - DNA, 20 bp, Artificial Sequence
  Synthetic
gcccagaatgctttgcccac

SEQ ID NO: 229 - DNA, 20 bp, Artificial Sequence
  Synthetic
agcaggcggagaagtagggg

SEQ ID NO: 230 - DNA, 20 bp, Artificial Sequence
  Synthetic
tctcctctagctccagcctc

SEQ ID NO: 231 - DNA, 20 bp, Artificial Sequence
  Synthetic
ggttaaatgaaagggaaagc

SEQ ID NO: 232 - DNA, 20 bp, Artificial Sequence
  Synthetic
ctaaagcgcgcctttcctca

SEQ ID NO: 233 - DNA, 20 bp, Artificial Sequence
  Synthetic
agaagatgctggcttggccc

SEQ ID NO: 234 - DNA, 20 bp, Artificial Sequence
  Synthetic
caggagctccttgctcttcc

SEQ ID NO: 235 - DNA, 20 bp, Artificial Sequence
  Synthetic
ctgtgtcatatgttgctggt

SEQ ID NO: 236 - DNA, 20 bp, Artificial Sequence
  Synthetic
tagcacattgggcagacaca

SEQ ID NO: 237 - DNA, 20 bp, Artificial Sequence
  Synthetic
gaagcatatcacttctgcta

SEQ ID NO: 238 - DNA, 20 bp, Artificial Sequence
  Synthetic
gttgtggaccgggctggcca

SEQ ID NO: 239 - DNA, 20 bp, Artificial Sequence
  Synthetic
tccagtggcctgtcttctcc

SEQ ID NO: 240 - DNA, 20 bp, Artificial Sequence
  Synthetic
aatttcctgctgtgacaaca

SEQ ID NO: 241 - DNA, 20 bp, Artificial Sequence
  Synthetic
caagggatttggggaggatg

SEQ ID NO: 242 - DNA, 20 bp, Artificial Sequence
  Synthetic
aggaagtagggaacagggac

SEQ ID NO: 243 - DNA, 20 bp, Artificial Sequence
  Synthetic
acctccatctctataaaaat

SEQ ID NO: 244 - DNA, 20 bp, Artificial Sequence
  Synthetic
ttacttctctttggctatga

SEQ ID NO: 245 - DNA, 20 bp, Artificial Sequence
  Synthetic
tcccactggcccacgttgca

SEQ ID NO: 246 - DNA, 20 bp, Artificial Sequence
  Synthetic
cagccatgttgcttctcctt

SEQ ID NO: 247 - DNA, 20 bp, Artificial Sequence
  Synthetic
tatttttctccctgtttaga

SEQ ID NO: 248 - DNA, 20 bp, Artificial Sequence
  Synthetic
gggcaaagcattctgggcag

SEQ ID NO: 249 - DNA, 20 bp, Artificial Sequence
  Synthetic
gaaggaggcgagacacctgt

SEQ ID NO: 250 - DNA, 20 bp, Artificial Sequence
  Synthetic
atttcctgctgtgacaacaa

SEQ ID NO: 251 - DNA, 20 bp, Artificial Sequence
  Synthetic
aagaaaagaaatgcaagaaa

SEQ ID NO: 252 - DNA, 20 bp, Artificial Sequence
  Synthetic
gcttctcttgagggtgggga

SEQ ID NO: 253 - DNA, 20 bp, Artificial Sequence
  Synthetic
attaatctgtcttttgtcgt

SEQ ID NO: 254 - DNA, 20 bp, Artificial Sequence
  Synthetic
acaggaggaacgcacgcagc

SEQ ID NO: 255 - DNA, 20 bp, Artificial Sequence
  Synthetic
cctggttgtcagacactccc

SEQ ID NO: 256 - DNA, 20 bp, Artificial Sequence
  Synthetic
aggtcaacatcaattgtgcc

SEQ ID NO: 257 - DNA, 20 bp, Artificial Sequence
  Synthetic
gacaagggatttggggagga

SEQ ID NO: 258 - DNA, 20 bp, Artificial Sequence
  Synthetic
ggcttagatctaaatactcc

SEQ ID NO: 259 - DNA, 20 bp, Artificial Sequence
  Synthetic
gagcacacagcctcacagta

SEQ ID NO: 260 - DNA, 20 bp, Artificial Sequence
  Synthetic
gttaccatcagagattgcag

SEQ ID NO: 261 - DNA, 20 bp, Artificial Sequence
  Synthetic
ttggatttagcaatgtttac

SEQ ID NO: 262 - DNA, 20 bp, Artificial Sequence
  Synthetic
cttggagttttgataggcac

SEQ ID NO: 263 - DNA, 20 bp, Artificial Sequence
  Synthetic
atttaataaaagagaaacct

SEQ ID NO: 264 - DNA, 20 bp, Artificial Sequence
  Synthetic
tttaataaaagagaaacctt

SEQ ID NO: 265 - DNA, 20 bp, Artificial Sequence
  Synthetic
attaaaaagcagggagaagg

SEQ ID NO: 266 - DNA, 20 bp, Artificial Sequence
  Synthetic
gagttccagaagcatctgtc

SEQ ID NO: 267 - DNA, 20 bp, Artificial Sequence
  Synthetic
gaagatgctggcttggccca

SEQ ID NO: 268 - DNA, 20 bp, Artificial Sequence
  Synthetic
gctagaggagagagagtctt

SEQ ID NO: 269 - DNA, 20 bp, Artificial Sequence
  Synthetic
cgaaggaggcgagacacctg

SEQ ID NO: 270 - DNA, 20 bp, Artificial Sequence
  Synthetic
gacaaacagcctttgtcttc

SEQ ID NO: 271 - DNA, 20 bp, Artificial Sequence
  Synthetic
tattggattcaatgccaata

SEQ ID NO: 272 - DNA, 20 bp, Artificial Sequence
  Synthetic
tccccaccctcaagagaagc

SEQ ID NO: 273 - DNA, 20 bp, Artificial Sequence
  Synthetic
tcacagcagagtggcccttt

SEQ ID NO: 274 - DNA, 20 bp, Artificial Sequence
  Synthetic
gattgagagggaattggaac

SEQ ID NO: 275 - DNA, 20 bp, Artificial Sequence
  Synthetic
ttttgggagaccaaaggcaa

SEQ ID NO: 276 - DNA, 20 bp, Artificial Sequence
  Synthetic
cccagcttctcttgagggtg

SEQ ID NO: 277 - DNA, 20 bp, Artificial Sequence
  Synthetic
gactgcactcacctcggaac

SEQ ID NO: 278 - DNA, 20 bp, Artificial Sequence
  Synthetic
ggcaacagggtccggttccg

SEQ ID NO: 279 - DNA, 20 bp, Artificial Sequence
  Synthetic
tgacgaggttgggggtgtcc

SEQ ID NO: 280 - DNA, 20 bp, Artificial Sequence
  Synthetic
taggctttgccctcatacat

SEQ ID NO: 281 - DNA, 20 bp, Artificial Sequence
  Synthetic
tgaagcatatcacttctgct

SEQ ID NO: 282 - DNA, 20 bp, Artificial Sequence
  Synthetic
aatcagaattcttggtttca

SEQ ID NO: 283 - DNA, 20 bp, Artificial Sequence
  Synthetic
gatgttctaaaaatccttat

SEQ ID NO: 284 - DNA, 20 bp, Artificial Sequence
  Synthetic
agacaaatgctttctgcggg

SEQ ID NO: 285 - DNA, 20 bp, Artificial Sequence
  Synthetic
tgttaccatcagagattgca

SEQ ID NO: 286 - DNA, 20 bp, Artificial Sequence
  Synthetic
cccgccaaagcgttttgcgc

SEQ ID NO: 287 - DNA, 20 bp, Artificial Sequence
  Synthetic
cagttgtgtggaaatatgat

SEQ ID NO: 288 - DNA, 20 bp, Artificial Sequence
  Synthetic
acgatgtccacaaagaagac

SEQ ID NO: 289 - DNA, 20 bp, Artificial Sequence
  Synthetic
ttaggcgacaggcatattca

SEQ ID NO: 290 - DNA, 20 bp, Artificial Sequence
  Synthetic
gctggtttaaagcactgatg

SEQ ID NO: 291 - DNA, 20 bp, Artificial Sequence
  Synthetic
ccaggaaacgtcctctttat

SEQ ID NO: 292 - DNA, 20 bp, Artificial Sequence
  Synthetic
tcagcccattccctataaag

SEQ ID NO: 293 - DNA, 20 bp, Artificial Sequence
  Synthetic
agaaagctttctgtatctca

SEQ ID NO: 294 - DNA, 20 bp, Artificial Sequence
  Synthetic
acttattaaataagtatgga

SEQ ID NO: 295 - DNA, 20 bp, Artificial Sequence
  Synthetic
attggattgcacccaggaat

SEQ ID NO: 296 - DNA, 20 bp, Artificial Sequence
  Synthetic
tgctttcagagccaattcct

SEQ ID NO: 297 - DNA, 20 bp, Artificial Sequence
  Synthetic
ttctgccccttggtccaaaa

SEQ ID NO: 298 - DNA, 20 bp, Artificial Sequence
  Synthetic
caaatggtgagctgagggac

SEQ ID NO: 299 - DNA, 20 bp, Artificial Sequence
  Synthetic
cctttagcttccaccactct

SEQ ID NO: 300 - DNA, 20 bp, Artificial Sequence
  Synthetic
aggtcaacctagtttaaata

SEQ ID NO: 301 - DNA, 20 bp, Artificial Sequence
  Synthetic
ttggttgcctgtcttctttg

SEQ ID NO: 302 - DNA, 20 bp, Artificial Sequence
  Synthetic
agaaatccgagagtgagccc

SEQ ID NO: 303 - DNA, 20 bp, Artificial Sequence
  Synthetic
actgcaaccttccgcccgcc

SEQ ID NO: 304 - DNA, 20 bp, Artificial Sequence
  Synthetic
atcgattgaacccaggcggg

SEQ ID NO: 305 - DNA, 20 bp, Artificial Sequence
  Synthetic
taggcgacaggcatattcat

SEQ ID NO: 306 - DNA, 20 bp, Artificial Sequence
  Synthetic
ggcgtgttccaggaagagca

SEQ ID NO: 307 - DNA, 20 bp, Artificial Sequence
  Synthetic
caagcacacgctcacctcga

SEQ ID NO: 308 - DNA, 20 bp, Artificial Sequence
  Synthetic
tttattattatatgcatcat

SEQ ID NO: 309 - DNA, 20 bp, Artificial Sequence
  Synthetic
atctcagggttcttgccttg

SEQ ID NO: 310 - DNA, 20 bp, Artificial Sequence
  Synthetic
cttatttaataagttttaca

SEQ ID NO: 311 - DNA, 20 bp, Artificial Sequence
  Synthetic
ggcaaccaatttctaacatc

SEQ ID NO: 312 - DNA, 20 bp, Artificial Sequence
  Synthetic
agaagcagtggagggtaaat

SEQ ID NO: 313 - DNA, 20 bp, Artificial Sequence
  Synthetic
atcacagaagccatctaaac

SEQ ID NO: 314 - DNA, 20 bp, Artificial Sequence
  Synthetic
gctggcttggcccagggtgg

SEQ ID NO: 315 - DNA, 20 bp, Artificial Sequence
  Synthetic
tttagcaatgtttactgggt

SEQ ID NO: 316 - DNA, 20 bp, Artificial Sequence
  Synthetic
ctgtttgttcagattcgtgt

SEQ ID NO: 317 - DNA, 20 bp, Artificial Sequence
  Synthetic
actgagaaaactgcagaagc

SEQ ID NO: 318 - DNA, 20 bp, Artificial Sequence
  Synthetic
taaattaattaaaattggcc

SEQ ID NO: 319 - DNA, 20 bp, Artificial Sequence
  Synthetic
tctccaggtgccctgcaacg

SEQ ID NO: 320 - DNA, 20 bp, Artificial Sequence
  Synthetic
ttcccactggcccacgttgc

SEQ ID NO: 321 - DNA, 20 bp, Artificial Sequence
  Synthetic
tcgcttagcatatgtggttg

SEQ ID NO: 322 - DNA, 20 bp, Artificial Sequence
  Synthetic
gatgcttctggaactcaagg

SEQ ID NO: 323 - DNA, 20 bp, Artificial Sequence
  Synthetic
cagcatgtgccaagccctcg

SEQ ID NO: 324 - DNA, 20 bp, Artificial Sequence
  Synthetic
tcacaacaacttcggcctcc

SEQ ID NO: 325 - DNA, 20 bp, Artificial Sequence
  Synthetic
atcatcgcagaaggttgcat

SEQ ID NO: 326 - DNA, 20 bp, Artificial Sequence
  Synthetic
ggcctttaacagcacttgaa

SEQ ID NO: 327 - DNA, 20 bp, Artificial Sequence
  Synthetic
cgaggcgggcaaaccacttg

SEQ ID NO: 328 - DNA, 20 bp, Artificial Sequence
  Synthetic
tctgaagggccctgtcagtt

SEQ ID NO: 329 - DNA, 20 bp, Artificial Sequence
  Synthetic
agaaatatctcagcctctaa

SEQ ID NO: 330 - DNA, 20 bp, Artificial Sequence
  Synthetic
gatgctggcttggcccaggg

SEQ ID NO: 331 - DNA, 20 bp, Artificial Sequence
  Synthetic
ccacggcaagtgtggcaaca

SEQ ID NO: 332 - DNA, 20 bp, Artificial Sequence
  Synthetic
ccaagcacacgctcacctcg

SEQ ID NO: 333 - DNA, 20 bp, Artificial Sequence
  Synthetic
catcttcacaccgcaatgtt

SEQ ID NO: 334 - DNA, 20 bp, Artificial Sequence
  Synthetic
ttgtgtggaaatatgattgg

SEQ ID NO: 335 - DNA, 20 bp, Artificial Sequence
  Synthetic
ctgcttagattttcttgctg

SEQ ID NO: 336 - DNA, 20 bp, Artificial Sequence
  Synthetic
ctccaggtgccctgcaacgt

SEQ ID NO: 337 - DNA, 20 bp, Artificial Sequence
  Synthetic
gatgcatcccattgtacagc

SEQ ID NO: 338 - DNA, 20 bp, Artificial Sequence
  Synthetic
gaaggtttcagcgaagacaa

SEQ ID NO: 339 - DNA, 20 bp, Artificial Sequence
  Synthetic
gtagtgcccacaggatctgc

SEQ ID NO: 340 - DNA, 20 bp, Artificial Sequence
  Synthetic
tcaggttcccagctgtacaa

SEQ ID NO: 341 - DNA, 20 bp, Artificial Sequence
  Synthetic
tccaaaattggattgcaccc

SEQ ID NO: 342 - DNA, 20 bp, Artificial Sequence
  Synthetic
ctccctctggtacaatgttg

SEQ ID NO: 343 - DNA, 20 bp, Artificial Sequence
  Synthetic
cacctgtgggcaaagcattc

SEQ ID NO: 344 - DNA, 20 bp, Artificial Sequence
  Synthetic
aggaccatccagggcaaatt

SEQ ID NO: 345 - DNA, 20 bp, Artificial Sequence
  Synthetic
agtaacaaaagtcatcagcc

SEQ ID NO: 346 - DNA, 20 bp, Artificial Sequence
  Synthetic
ctgcaaccttccgcccgcct

SEQ ID NO: 347 - DNA, 20 bp, Artificial Sequence
  Synthetic
acagatgcttctggaactca

SEQ ID NO: 348 - DNA, 20 bp, Artificial Sequence
  Synthetic
gggcgggcggaaggggaaga

SEQ ID NO: 349 - DNA, 20 bp, Artificial Sequence
  Synthetic
ccctgttgccacacttgccg

SEQ ID NO: 350 - DNA, 20 bp, Artificial Sequence
  Synthetic
cgtttcctggccggacgcag

SEQ ID NO: 351 - DNA, 20 bp, Artificial Sequence
  Synthetic
cagccttgtcaacactaggt

SEQ ID NO: 352 - DNA, 20 bp, Artificial Sequence
  Synthetic
ggaccatccagggcaaattg

SEQ ID NO: 353 - DNA, 20 bp, Artificial Sequence
  Synthetic
gtaacaaaagtcatcagcct

SEQ ID NO: 354 - DNA, 20 bp, Artificial Sequence
  Synthetic
atgcatcccattgtacagct

SEQ ID NO: 355 - DNA, 20 bp, Artificial Sequence
  Synthetic
tctcgctgtgttgctcaggg

SEQ ID NO: 356 - DNA, 20 bp, Artificial Sequence
  Synthetic
actggggaagtagtgcccac

SEQ ID NO: 357 - DNA, 20 bp, Artificial Sequence
  Synthetic
gctgaagcagatacaccaca

SEQ ID NO: 358 - DNA, 20 bp, Artificial Sequence
  Synthetic
actgacagcacccaacattg

SEQ ID NO: 359 - DNA, 20 bp, Artificial Sequence
  Synthetic
ccatcttcacaccgcaatgt

SEQ ID NO: 360 - DNA, 20 bp, Artificial Sequence
  Synthetic
tacagtggacacaaaaaaag

SEQ ID NO: 361 - DNA, 20 bp, Artificial Sequence
  Synthetic
gagtctcgctgtgttgctca

SEQ ID NO: 362 - DNA, 20 bp, Artificial Sequence
  Synthetic
attactgaccacagtttcaa

SEQ ID NO: 363 - DNA, 20 bp, Artificial Sequence
  Synthetic
atgtgctagatgatccatag

SEQ ID NO: 364 - DNA, 20 bp, Artificial Sequence
  Synthetic
tatccagatggagatgcata

SEQ ID NO: 365 - DNA, 20 bp, Artificial Sequence
  Synthetic
tctgaggtaccatatcctta

SEQ ID NO: 366 - DNA, 20 bp, Artificial Sequence
  Synthetic
caggaaacgtcctctttata

SEQ ID NO: 367 - DNA, 20 bp, Artificial Sequence
  Synthetic
aattgccttcacttaggcgt

SEQ ID NO: 368 - DNA, 20 bp, Artificial Sequence
  Synthetic
agagggagcctttgaaactg

SEQ ID NO: 369 - DNA, 20 bp, Artificial Sequence
  Synthetic
gcgtgtgcttggcgtgttcc

SEQ ID NO: 370 - DNA, 20 bp, Artificial Sequence
  Synthetic
ttgaaaataagaagttggct

SEQ ID NO: 371 - DNA, 20 bp, Artificial Sequence
  Synthetic
atctgcgggcagattacgcg

SEQ ID NO: 372 - DNA, 20 bp, Artificial Sequence
  Synthetic
gtaagcactgaatggcctac

SEQ ID NO: 373 - DNA, 20 bp, Artificial Sequence
  Synthetic
caggaccatccagggcaaat

SEQ ID NO: 374 - DNA, 20 bp, Artificial Sequence
  Synthetic
attctgccccttggtccaaa

SEQ ID NO: 375 - DNA, 20 bp, Artificial Sequence
  Synthetic
atgcataaggcccatagaca

SEQ ID NO: 376 - DNA, 20 bp, Artificial Sequence
  Synthetic
atgcatctttcccatgtcta

SEQ ID NO: 377 - DNA, 20 bp, Artificial Sequence
  Synthetic
tcctgggtgcaatccaattt

SEQ ID NO: 378 - DNA, 20 bp, Artificial Sequence
  Synthetic
gcctttcctcatgggttgca

SEQ ID NO: 379 - DNA, 20 bp, Artificial Sequence
  Synthetic
agagctgccatttgcggggc

SEQ ID NO: 380 - DNA, 20 bp, Artificial Sequence
  Synthetic
acaccccaatttgccctgga

SEQ ID NO: 381 - DNA, 20 bp, Artificial Sequence
  Synthetic
tttcgctgtgtctgtctacc

SEQ ID NO: 382 - DNA, 20 bp, Artificial Sequence
  Synthetic
ttacaaaaatgatccgggcg

SEQ ID NO: 383 - DNA, 20 bp, Artificial Sequence
  Synthetic
ctgctttcagagccaattcc

SEQ ID NO: 384 - DNA, 20 bp, Artificial Sequence
  Synthetic
ccccaccctcaagagaagct

SEQ ID NO: 385 - DNA, 20 bp, Artificial Sequence
  Synthetic
ggttgcccaggggctggggg

SEQ ID NO: 386 - DNA, 20 bp, Artificial Sequence
  Synthetic
gtccacaacattgtaccaga

SEQ ID NO: 387 - DNA, 20 bp, Artificial Sequence
  Synthetic
acctgtgggcaaagcattct

SEQ ID NO: 388 - DNA, 20 bp, Artificial Sequence
  Synthetic
ttccaagtagctcggatcac

SEQ ID NO: 389 - DNA, 20 bp, Artificial Sequence
  Synthetic
cagtgtggtggctgcaggtg

SEQ ID NO: 390 - DNA, 20 bp, Artificial Sequence
  Synthetic
attttcccacattatgtata

SEQ ID NO: 391 - DNA, 20 bp, Artificial Sequence
  Synthetic
gggatgagctcttaaaagaa

SEQ ID NO: 392 - DNA, 20 bp, Artificial Sequence
  Synthetic
tagaatttaatattccaaac

SEQ ID NO: 393 - DNA, 20 bp, Artificial Sequence
  Synthetic
gaggtttcctgactctcagt

SEQ ID NO: 394 - DNA, 20 bp, Artificial Sequence
  Synthetic
aatctaagcagactctttca

SEQ ID NO: 395 - DNA, 20 bp, Artificial Sequence
  Synthetic
tttgggagaccaaaggcaag

SEQ ID NO: 396 - DNA, 20 bp, Artificial Sequence
  Synthetic
aatgtaccttgcaacccatg

SEQ ID NO: 397 - DNA, 20 bp, Artificial Sequence
  Synthetic
agtgaaatatttcgattatg

SEQ ID NO: 398 - DNA, 20 bp, Artificial Sequence
  Synthetic
cagatgcttctggaactcaa

SEQ ID NO: 399 - DNA, 20 bp, Artificial Sequence
  Synthetic
agtagtgcccacaggatctg

SEQ ID NO: 400 - DNA, 20 bp, Artificial Sequence
  Synthetic
ctcctgggcccttgttccac

SEQ ID NO: 401 - DNA, 20 bp, Artificial Sequence
  Synthetic
taataagttttacatggcac

SEQ ID NO: 402 - DNA, 20 bp, Artificial Sequence
  Synthetic
tctgctcagaatttctcctc

SEQ ID NO: 403 - DNA, 20 bp, Artificial Sequence
  Synthetic
aggagggggcaaggagtaaa

SEQ ID NO: 404 - DNA, 20 bp, Artificial Sequence
  Synthetic
tagagctgccatttgcgggg

SEQ ID NO: 405 - DNA, 20 bp, Artificial Sequence
  Synthetic
acagtttcaaaggctccctc

SEQ ID NO: 406 - DNA, 20 bp, Artificial Sequence
  Synthetic
cggtagccactagtttcatg

SEQ ID NO: 407 - DNA, 20 bp, Artificial Sequence
  Synthetic
ccttacaccccaatttgccc

SEQ ID NO: 408 - DNA, 20 bp, Artificial Sequence
  Synthetic
aagaaatacaataaattagc

SEQ ID NO: 409 - DNA, 20 bp, Artificial Sequence
  Synthetic
ctaaacctgagtgtaaaaaa

SEQ ID NO: 410 - DNA, 20 bp, Artificial Sequence
  Synthetic
ccagtcccagcttctcttga

SEQ ID NO: 411 - DNA, 20 bp, Artificial Sequence
  Synthetic
agaaacggaagtctgaggct

SEQ ID NO: 412 - DNA, 20 bp, Artificial Sequence
  Synthetic
cccaggagaagacaggccac

SEQ ID NO: 413 - DNA, 20 bp, Artificial Sequence
  Synthetic
aagtcgatccgtggttgccc

SEQ ID NO: 414 - DNA, 20 bp, Artificial Sequence
  Synthetic
aagaaacggaagtctgaggc

SEQ ID NO: 415 - DNA, 20 bp, Artificial Sequence
  Synthetic
gccacggcaagtgtggcaac

SEQ ID NO: 416 - DNA, 20 bp, Artificial Sequence
  Synthetic
atgacgaggttgggggtgtc

SEQ ID NO: 417 - DNA, 20 bp, Artificial Sequence
  Synthetic
aaagcctaatcacctcccaa

SEQ ID NO: 418 - DNA, 20 bp, Artificial Sequence
  Synthetic
ggtctcccaaaaagaggatc

SEQ ID NO: 419 - DNA, 20 bp, Artificial Sequence
  Synthetic
taggtttgatggcctgcttc

SEQ ID NO: 420 - DNA, 20 bp, Artificial Sequence
  Synthetic
cttggcgctatactaggact

SEQ ID NO: 421 - DNA, 20 bp, Artificial Sequence
  Synthetic
ggaaacgctaccatcaaata

SEQ ID NO: 422 - DNA, 20 bp, Artificial Sequence
  Synthetic
cctactgtgtgccctaccct

SEQ ID NO: 423 - DNA, 20 bp, Artificial Sequence
  Synthetic
catccctctggcccagggta

SEQ ID NO: 424 - DNA, 20 bp, Artificial Sequence
  Synthetic
tggagcatccctctggccca

SEQ ID NO: 425 - DNA, 20 bp, Artificial Sequence
  Synthetic
tgtagatgctctgcttttga

SEQ ID NO: 426 - DNA, 20 bp, Artificial Sequence
  Synthetic
gtagtcccagctaccatggg

SEQ ID NO: 427 - DNA, 20 bp, Artificial Sequence
  Synthetic
gcttggcgctatactaggac

SEQ ID NO: 428 - DNA, 20 bp, Artificial Sequence
  Synthetic
aaaaaaacaagtctgggaaa

SEQ ID NO: 429 - DNA, 20 bp, Artificial Sequence
  Synthetic
tgccccctccctcctgaagc

SEQ ID NO: 430 - DNA, 20 bp, Artificial Sequence
  Synthetic
ctaaaattacaaaaatgatc

SEQ ID NO: 431 - DNA, 20 bp, Artificial Sequence
  Synthetic
tctctctgctcacttccata

SEQ ID NO: 432 - DNA, 20 bp, Artificial Sequence
  Synthetic
tcctctttttgggagaccaa

SEQ ID NO: 433 - DNA, 20 bp, Artificial Sequence
  Synthetic
tcacagaagccatctaaaca

SEQ ID NO: 434 - DNA, 20 bp, Artificial Sequence
  Synthetic
aatgtttactgggtgggtgg

SEQ ID NO: 435 - DNA, 20 bp, Artificial Sequence
  Synthetic
gcgcacatgtctcttagcct

SEQ ID NO: 436 - DNA, 20 bp, Artificial Sequence
  Synthetic
tgctggtttaaagcactgat

SEQ ID NO: 437 - DNA, 20 bp, Artificial Sequence
  Synthetic
gcctttggtctcccaaaaag

SEQ ID NO: 438 - DNA, 20 bp, Artificial Sequence
  Synthetic
cagtgccagatcctcttttt

SEQ ID NO: 439 - DNA, 20 bp, Artificial Sequence
  Synthetic
cgggcagattacgcgtggca

SEQ ID NO: 440 - DNA, 20 bp, Artificial Sequence
  Synthetic
gagagtcttaggagatgacg

SEQ ID NO: 441 - DNA, 20 bp, Artificial Sequence
  Synthetic
aaggggcaagctagtgatac

SEQ ID NO: 442 - DNA, 20 bp, Artificial Sequence
  Synthetic
gtggagtttggccaggctgt

SEQ ID NO: 443 - DNA, 20 bp, Artificial Sequence
  Synthetic
cccactcttctccgacagcc

SEQ ID NO: 444 - DNA, 20 bp, Artificial Sequence
  Synthetic
atatggcacctggacacaca

SEQ ID NO: 445 - DNA, 20 bp, Artificial Sequence
  Synthetic
gcatttgtctgtagacagcc

SEQ ID NO: 446 - DNA, 20 bp, Artificial Sequence
  Synthetic
gttgcccaggggctggggga

SEQ ID NO: 447 - DNA, 20 bp, Artificial Sequence
  Synthetic
agatgcttctggaactcaag

SEQ ID NO: 448 - DNA, 20 bp, Artificial Sequence
  Synthetic
gctggattctgactacactg

SEQ ID NO: 449 - DNA, 20 bp, Artificial Sequence
  Synthetic
aaaaaaaaagtcattgttct

SEQ ID NO: 450 - DNA, 20 bp, Artificial Sequence
  Synthetic
aggcctgggggtggagcccg

SEQ ID NO: 451 - DNA, 20 bp, Artificial Sequence
  Synthetic
attaatgtagcaaagtggac

SEQ ID NO: 452 - DNA, 20 bp, Artificial Sequence
  Synthetic
gccctgcaacgtgggccagt

SEQ ID NO: 453 - DNA, 20 bp, Artificial Sequence
  Synthetic
ttctcttacaccgcacatat

SEQ ID NO: 454 - DNA, 20 bp, Artificial Sequence
  Synthetic
aaaaataggtttaaaaatat

SEQ ID NO: 455 - DNA, 20 bp, Artificial Sequence
  Synthetic
cacaacaacttcggcctcct

SEQ ID NO: 456 - DNA, 20 bp, Artificial Sequence
  Synthetic
gcaaggttttattgagtgga

SEQ ID NO: 457 - DNA, 20 bp, Artificial Sequence
  Synthetic
tatctcagggttcttgcctt

SEQ ID NO: 458 - DNA, 20 bp, Artificial Sequence
  Synthetic
atgtctgggaaggccgggtg

SEQ ID NO: 459 - DNA, 20 bp, Artificial Sequence
  Synthetic
tgcatctttcccatgtctat

SEQ ID NO: 460 - DNA, 20 bp, Artificial Sequence
  Synthetic
tgtgaaagtgttactatttt

SEQ ID NO: 461 - DNA, 20 bp, Artificial Sequence
  Synthetic
aagaaagagaatagatagta

SEQ ID NO: 462 - DNA, 20 bp, Artificial Sequence
  Synthetic
ctagcctatgagctttatga

SEQ ID NO: 463 - DNA, 20 bp, Artificial Sequence
  Synthetic
tccacgctgctgaggcagtg

SEQ ID NO: 464 - DNA, 20 bp, Artificial Sequence
  Synthetic
tttctatggccagcttcagg

SEQ ID NO: 465 - DNA, 20 bp, Artificial Sequence
  Synthetic
gggaaggaacgctctatggt

SEQ ID NO: 466 - DNA, 20 bp, Artificial Sequence
  Synthetic
gggcagattacgcgtggcag

SEQ ID NO: 467 - DNA, 20 bp, Artificial Sequence
  Synthetic
cttgccatcataaagctcat

SEQ ID NO: 468 - DNA, 20 bp, Artificial Sequence
  Synthetic
gagttttgataggcacagga

SEQ ID NO: 469 - DNA, 20 bp, Artificial Sequence
  Synthetic
gcaagaaatgggtccaaaat

SEQ ID NO: 470 - DNA, 20 bp, Artificial Sequence
  Synthetic
ggatgggacagagcatctcc

SEQ ID NO: 471 - DNA, 20 bp, Artificial Sequence
  Synthetic
gttccgccggttgatggcct

SEQ ID NO: 472 - DNA, 20 bp, Artificial Sequence
  Synthetic
tttttacactcaggtttagt

SEQ ID NO: 473 - DNA, 20 bp, Artificial Sequence
  Synthetic
tgccctgcaacgtgggccag

SEQ ID NO: 474 - DNA, 20 bp, Artificial Sequence
  Synthetic
tgggccagtgggaaggtttg

SEQ ID NO: 475 - DNA, 20 bp, Artificial Sequence
  Synthetic
gacaaatgctttctgcggga

SEQ ID NO: 476 - DNA, 20 bp, Artificial Sequence
  Synthetic
cagattacgcgtggcagggg

SEQ ID NO: 477 - DNA, 20 bp, Artificial Sequence
  Synthetic
gccctgcaggaactggctcc

SEQ ID NO: 478 - DNA, 20 bp, Artificial Sequence
  Synthetic
tctttagcaggtagagtacc

SEQ ID NO: 479 - DNA, 20 bp, Artificial Sequence
  Synthetic
cacctaccaagcccgactcc

SEQ ID NO: 480 - DNA, 20 bp, Artificial Sequence
  Synthetic
ctcctggagtcgggcttggt

SEQ ID NO: 481 - DNA, 20 bp, Artificial Sequence
  Synthetic
gatgcttttctcctggagtc

SEQ ID NO: 482 - DNA, 20 bp, Artificial Sequence
  Synthetic
actgaccttcctaggtttga

SEQ ID NO: 483 - DNA, 20 bp, Artificial Sequence
  Synthetic
gcaggccatcaaacctagga

SEQ ID NO: 484 - DNA, 20 bp, Artificial Sequence
  Synthetic
ctcatccctgactatctgct

SEQ ID NO: 485 - DNA, 20 bp, Artificial Sequence
  Synthetic
gtgggccagtgggaaggttt

SEQ ID NO: 486 - DNA, 20 bp, Artificial Sequence
  Synthetic
agaatcgattgaacccaggc

SEQ ID NO: 487 - DNA, 20 bp, Artificial Sequence
  Synthetic
acgtcctctttatagggaat

SEQ ID NO: 488 - DNA, 20 bp, Artificial Sequence
  Synthetic
ctatttggcaatttatacaa

SEQ ID NO: 489 - DNA, 20 bp, Artificial Sequence
  Synthetic
caaaaatcagctgggctttg

SEQ ID NO: 490 - DNA, 20 bp, Artificial Sequence
  Synthetic
ggctgtgaggcagtttctga

SEQ ID NO: 491 - DNA, 20 bp, Artificial Sequence
  Synthetic
cgtacaaaaggggccgggcg

SEQ ID NO: 492 - DNA, 20 bp, Artificial Sequence
  Synthetic
cttcttattttcaaatccaa

SEQ ID NO: 493 - DNA, 20 bp, Artificial Sequence
  Synthetic
cgttccgccggttgatggcc

SEQ ID NO: 494 - DNA, 20 bp, Artificial Sequence
  Synthetic
actactaccacattggtgac

SEQ ID NO: 495 - DNA, 20 bp, Artificial Sequence
  Synthetic
cacaaggggcttgaggaccc

SEQ ID NO: 496 - DNA, 20 bp, Artificial Sequence
  Synthetic
ttatagggaatgggctgagc

SEQ ID NO: 497 - DNA, 20 bp, Artificial Sequence
  Synthetic
ctttagcaggtagagtacct

SEQ ID NO: 498 - DNA, 20 bp, Artificial Sequence
  Synthetic
cctagacactgccgtgggtt

SEQ ID NO: 499 - DNA, 20 bp, Artificial Sequence
  Synthetic
gctgtggggctccaaaccca

SEQ ID NO: 500 - DNA, 20 bp, Artificial Sequence
  Synthetic
catagcgggtgagtaaccag

SEQ ID NO: 501 - DNA, 20 bp, Artificial Sequence
  Synthetic
ctcttagcctaggaagattc

SEQ ID NO: 502 - DNA, 20 bp, Artificial Sequence
  Synthetic
taaagaaattgccttcactt

SEQ ID NO: 503 - DNA, 20 bp, Artificial Sequence
  Synthetic
ttcatccaacgcctaagtga

SEQ ID NO: 504 - DNA, 20 bp, Artificial Sequence
  Synthetic
tggctggattctgactacac

SEQ ID NO: 505 - DNA, 20 bp, Artificial Sequence
  Synthetic
ctactaccacattggtgact

SEQ ID NO: 506 - DNA, 20 bp, Artificial Sequence
  Synthetic
tacttcgatgggctatgcag

SEQ ID NO: 507 - DNA, 20 bp, Artificial Sequence
  Synthetic
tgtccaggtgccatatttga

SEQ ID NO: 508 - DNA, 20 bp, Artificial Sequence
  Synthetic
tgcataaggcccatagacat

SEQ ID NO: 509 - DNA, 20 bp, Artificial Sequence
  Synthetic
gcccaggggctgggggaggg

SEQ ID NO: 510 - DNA, 20 bp, Artificial Sequence
  Synthetic
accttgcaacccatgaggaa

SEQ ID NO: 511 - DNA, 20 bp, Artificial Sequence
  Synthetic
attacgcgtggcaggggtgg

SEQ ID NO: 512 - DNA, 20 bp, Artificial Sequence
  Synthetic
tgtgtgtgttgggtgggagt

SEQ ID NO: 513 - DNA, 20 bp, Artificial Sequence
  Synthetic
atcataatacatctcagagg

SEQ ID NO: 514 - DNA, 20 bp, Artificial Sequence
  Synthetic
ctaccatcctatggccacca

SEQ ID NO: 515 - DNA, 20 bp, Artificial Sequence
  Synthetic
aacctctttggaaaactatt

SEQ ID NO: 516 - DNA, 20 bp, Artificial Sequence
  Synthetic
ccccttgtgagcagagagtg

SEQ ID NO: 517 - DNA, 20 bp, Artificial Sequence
  Synthetic
catgaaccttgagataagtg

SEQ ID NO: 518 - DNA, 20 bp, Artificial Sequence
  Synthetic
cagaaaaacttcacactgct

SEQ ID NO: 519 - DNA, 20 bp, Artificial Sequence
  Synthetic
ggcccatttcaggagagaaa

SEQ ID NO: 520 - DNA, 20 bp, Artificial Sequence
  Synthetic
ttaaagcactgatggggtgc

SEQ ID NO: 521 - DNA, 20 bp, Artificial Sequence
  Synthetic
gcatattctggaaaactttt

SEQ ID NO: 522 - DNA, 20 bp, Artificial Sequence
  Synthetic
ctggagcatccctctggccc

SEQ ID NO: 523 - DNA, 20 bp, Artificial Sequence
  Synthetic
ctcccccctcccccagcccc

SEQ ID NO: 524 - DNA, 20 bp, Artificial Sequence
  Synthetic
tcccccctcccccagcccct

SEQ ID NO: 525 - DNA, 20 bp, Artificial Sequence
  Synthetic
tccgtggttgcccaggggct

SEQ ID NO: 526 - DNA, 20 bp, Artificial Sequence
  Synthetic
atccgtggttgcccaggggc

SEQ ID NO: 527 - DNA, 20 bp, Artificial Sequence
  Synthetic
cgacaaaagacagattaatg

SEQ ID NO: 528 - DNA, 20 bp, Artificial Sequence
  Synthetic
aagattagactgaccttcct

SEQ ID NO: 529 - DNA, 20 bp, Artificial Sequence
  Synthetic
cttgctgaggaaagaggagg

SEQ ID NO: 530 - DNA, 20 bp, Artificial Sequence
  Synthetic
gcagagagagaaggaacgac

SEQ ID NO: 531 - DNA, 20 bp, Artificial Sequence
  Synthetic
ctctgctcacaaggggcttg

SEQ ID NO: 532 - DNA, 20 bp, Artificial Sequence
  Synthetic
gacaaaagacagattaatga

SEQ ID NO: 533 - DNA, 20 bp, Artificial Sequence
  Synthetic
aagtatgcaatgaatgtcaa

SEQ ID NO: 534 - DNA, 20 bp, Artificial Sequence
  Synthetic
ccccagcccctgggcaacca

SEQ ID NO: 535 - DNA, 20 bp, Artificial Sequence
  Synthetic
gtgttactattttaggcgac

SEQ ID NO: 536 - DNA, 20 bp, Artificial Sequence
  Synthetic
aaagcagagcatctacatcg

SEQ ID NO: 537 - DNA, 20 bp, Artificial Sequence
  Synthetic
gggtcttactcttgtcgccc

SEQ ID NO: 538 - DNA, 20 bp, Artificial Sequence
  Synthetic
taaaacttattaaataagta

SEQ ID NO: 539 - DNA, 20 bp, Artificial Sequence
  Synthetic
atctgtgggcaagaaaaagg

SEQ ID NO: 540 - DNA, 20 bp, Artificial Sequence
  Synthetic
gagtacctgggagagagggt

SEQ ID NO: 541 - DNA, 20 bp, Artificial Sequence
  Synthetic
cctcactctctgctcacaag

SEQ ID NO: 542 - DNA, 20 bp, Artificial Sequence
  Synthetic
agctgggaacctgaagacaa

SEQ ID NO: 543 - DNA, 20 bp, Artificial Sequence
  Synthetic
gcgggcagattacgcgtggc

SEQ ID NO: 544 - DNA, 20 bp, Artificial Sequence
  Synthetic
aacacaaggaagtagggaac

SEQ ID NO: 545 - DNA, 20 bp, Artificial Sequence
  Synthetic
ctcaccagacccaaatctgc

SEQ ID NO: 546 - DNA, 20 bp, Artificial Sequence
  Synthetic
gaagggagatgcttttctcc

SEQ ID NO: 547 - DNA, 20 bp, Artificial Sequence
  Synthetic
aaatggagttttggtggtgt

SEQ ID NO: 548 - DNA, 20 bp, Artificial Sequence
  Synthetic
tgaagcaggccatcaaacct

SEQ ID NO: 549 - DNA, 20 bp, Artificial Sequence
  Synthetic
aggtttgatggcctgcttca

SEQ ID NO: 550 - DNA, 20 bp, Artificial Sequence
  Synthetic
cacctcttcttccctgaagc

SEQ ID NO: 551 - DNA, 20 bp, Artificial Sequence
  Synthetic
acagtgccagatcctctttt

SEQ ID NO: 552 - DNA, 20 bp, Artificial Sequence
  Synthetic
ctgttcatcaagagatgcaa

SEQ ID NO: 553 - DNA, 20 bp, Artificial Sequence
  Synthetic
ggctgggggaggggggagac

SEQ ID NO: 554 - DNA, 20 bp, Artificial Sequence
  Synthetic
ataatctgtgggcaagaaaa

SEQ ID NO: 555 - DNA, 20 bp, Artificial Sequence
  Synthetic
ttattattatatgcatcata

SEQ ID NO: 556 - DNA, 20 bp, Artificial Sequence
  Synthetic
taaacctatttttatagaga

SEQ ID NO: 557 - DNA, 20 bp, Artificial Sequence
  Synthetic
atctgctggcaccttgatcg

SEQ ID NO: 558 - DNA, 20 bp, Artificial Sequence
  Synthetic
ttgtttctatggccagcttc

SEQ ID NO: 559 - DNA, 20 bp, Artificial Sequence
  Synthetic
gaggtgagtgcagtcatccg

SEQ ID NO: 560 - DNA, 20 bp, Artificial Sequence
  Synthetic
aaaagcagagcatctacatc

SEQ ID NO: 561 - DNA, 20 bp, Artificial Sequence
  Synthetic
caagctagtgatactggagg

SEQ ID NO: 562 - DNA, 20 bp, Artificial Sequence
  Synthetic
aggatagagctgccatttgc

SEQ ID NO: 563 - DNA, 20 bp, Artificial Sequence
  Synthetic
agattacgcgtggcaggggt

SEQ ID NO: 564 - DNA, 20 bp, Artificial Sequence
  Synthetic
aggtgagtgcagtcatccga

SEQ ID NO: 565 - DNA, 20 bp, Artificial Sequence
  Synthetic
cctagagtggtggaagctaa

SEQ ID NO: 566 - DNA, 20 bp, Artificial Sequence
  Synthetic
cgatagacgccggcagcccc

SEQ ID NO: 567 - DNA, 20 bp, Artificial Sequence
  Synthetic
ccccgctgctcaaacctctg

SEQ ID NO: 568 - DNA, 20 bp, Artificial Sequence
  Synthetic
acttttcctcacttatctca

SEQ ID NO: 569 - DNA, 20 bp, Artificial Sequence
  Synthetic
aatcagctgggctttgtggc

SEQ ID NO: 570 - DNA, 20 bp, Artificial Sequence
  Synthetic
gccagtcccagcttctcttg

SEQ ID NO: 571 - DNA, 20 bp, Artificial Sequence
  Synthetic
aggggggagacagggagaat

SEQ ID NO: 572 - DNA, 20 bp, Artificial Sequence
  Synthetic
gtgtgtgtgttgggtgggag

SEQ ID NO: 573 - DNA, 20 bp, Artificial Sequence
  Synthetic
gggaggatcatgagagttgg

SEQ ID NO: 574 - DNA, 20 bp, Artificial Sequence
  Synthetic
aagtgtccttcaaggggtca

SEQ ID NO: 575 - DNA, 20 bp, Artificial Sequence
  Synthetic
taccatcctatggccaccag

SEQ ID NO: 576 - DNA, 20 bp, Artificial Sequence
  Synthetic
cctaccatcctatggccacc

SEQ ID NO: 577 - DNA, 20 bp, Artificial Sequence
  Synthetic
ccagctaccatgggaggctg

SEQ ID NO: 578 - DNA, 20 bp, Artificial Sequence
  Synthetic
ctgattcttccgatacccca

SEQ ID NO: 579 - DNA, 20 bp, Artificial Sequence
  Synthetic
cgtggttgcccaggggctgg

SEQ ID NO: 580 - DNA, 20 bp, Artificial Sequence
  Synthetic
gaggatagagctgccatttg

SEQ ID NO: 581 - DNA, 20 bp, Artificial Sequence
  Synthetic
agtctgaggctggggcaact

SEQ ID NO: 582 - DNA, 20 bp, Artificial Sequence
  Synthetic
agatgcttttctcctggagt

SEQ ID NO: 583 - DNA, 20 bp, Artificial Sequence
  Synthetic
cccatggtgagtacttcgat

SEQ ID NO: 584 - DNA, 20 bp, Artificial Sequence
  Synthetic
caacaattaatgagaaagta

SEQ ID NO: 585 - DNA, 20 bp, Artificial Sequence
  Synthetic
caatttgccctggatggtcc

SEQ ID NO: 586 - DNA, 20 bp, Artificial Sequence
  Synthetic
cgtaacatacccagtaccac

SEQ ID NO: 587 - DNA, 20 bp, Artificial Sequence
  Synthetic
tcttgctgaggaaagaggag

SEQ ID NO: 588 - DNA, 20 bp, Artificial Sequence
  Synthetic
ggtccacaacattgtaccag

SEQ ID NO: 589 - DNA, 20 bp, Artificial Sequence
  Synthetic
tcataatacatctcagaggt

SEQ ID NO: 590 - DNA, 20 bp, Artificial Sequence
  Synthetic
agggatgagctcttaaaaga

SEQ ID NO: 591 - DNA, 20 bp, Artificial Sequence
  Synthetic
cccagggtagggcacacagt

SEQ ID NO: 592 - DNA, 20 bp, Artificial Sequence
  Synthetic
tacagacaaatgctttctgc

SEQ ID NO: 593 - DNA, 20 bp, Artificial Sequence
  Synthetic
taaagcgcgcctttcctcat

SEQ ID NO: 594 - DNA, 20 bp, Artificial Sequence
  Synthetic
agtggcccttttggaccaag

SEQ ID NO: 595 - DNA, 20 bp, Artificial Sequence
  Synthetic
cctcactgagaaggtgatgt

SEQ ID NO: 596 - DNA, 20 bp, Artificial Sequence
  Synthetic
ggagaaaacacaaggaagta

SEQ ID NO: 597 - DNA, 20 bp, Artificial Sequence
  Synthetic
aagctagtgatactggaggg

SEQ ID NO: 598 - DNA, 20 bp, Artificial Sequence
  Synthetic
cgttgagaggagtgcgccgg

SEQ ID NO: 599 - DNA, 20 bp, Artificial Sequence
  Synthetic
tctgggaaatggagttttgg

SEQ ID NO: 600 - DNA, 20 bp, Artificial Sequence
  Synthetic
ttgcccaggggctgggggag

SEQ ID NO: 601 - DNA, 20 bp, Artificial Sequence
  Synthetic
ggggcgaatgtttacagctg

SEQ ID NO: 602 - DNA, 20 bp, Artificial Sequence
  Synthetic
tcaaaatgtctgggaaggcc

SEQ ID NO: 603 - DNA, 20 bp, Artificial Sequence
  Synthetic
tggcccatttcaggagagaa

SEQ ID NO: 604 - DNA, 20 bp, Artificial Sequence
  Synthetic
ttctcagtatttggaaagac

SEQ ID NO: 605 - DNA, 20 bp, Artificial Sequence
  Synthetic
gggtggggaggtcacagaac

SEQ ID NO: 606 - DNA, 20 bp, Artificial Sequence
  Synthetic
ttctggacagttcatttcaa

SEQ ID NO: 607 - DNA, 20 bp, Artificial Sequence
  Synthetic
agaaagaaggaaattgcttc

SEQ ID NO: 608 - DNA, 20 bp, Artificial Sequence
  Synthetic
gcaaggtggtctaacctctt

SEQ ID NO: 609 - DNA, 20 bp, Artificial Sequence
  Synthetic
ttccgccggttgatggcctg

SEQ ID NO: 610 - DNA, 20 bp, Artificial Sequence
  Synthetic
gcccatggtgagtacttcga

SEQ ID NO: 611 - DNA, 20 bp, Artificial Sequence
  Synthetic
ggggcaaacattgtgtatga

SEQ ID NO: 612 - DNA, 20 bp, Artificial Sequence
  Synthetic
taagtatatttacagatttg

SEQ ID NO: 613 - DNA, 20 bp, Artificial Sequence
  Synthetic
ccgtggttgcccaggggctg

SEQ ID NO: 614 - DNA, 20 bp, Artificial Sequence
  Synthetic
aatctgcccgcagatcctgt

SEQ ID NO: 615 - DNA, 20 bp, Artificial Sequence
  Synthetic
acacaaggaagtagggaaca

SEQ ID NO: 616 - DNA, 20 bp, Artificial Sequence
  Synthetic
gccaggctgtcggagaagag

SEQ ID NO: 617 - DNA, 20 bp, Artificial Sequence
  Synthetic
ttaatgtagcaaagtggaca

SEQ ID NO: 618 - DNA, 20 bp, Artificial Sequence
  Synthetic
tgcaacgtgggccagtggga

SEQ ID NO: 619 - DNA, 20 bp, Artificial Sequence
  Synthetic
agctccccaaaccttcccac

SEQ ID NO: 620 - DNA, 20 bp, Artificial Sequence
  Synthetic
agagtggcccttttggacca

SEQ ID NO: 621 - DNA, 20 bp, Artificial Sequence
  Synthetic
actacattaatgtagcaaag

SEQ ID NO: 622 - DNA, 20 bp, Artificial Sequence
  Synthetic
tgactagtcccatgtggtat

SEQ ID NO: 623 - DNA, 20 bp, Artificial Sequence
  Synthetic
gatgctattaataattctgt

SEQ ID NO: 624 - DNA, 20 bp, Artificial Sequence
  Synthetic
ctgcctcgggctccaccccc

SEQ ID NO: 625 - DNA, 20 bp, Artificial Sequence
  Synthetic
ggttgatggcctggggctgc

SEQ ID NO: 626 - DNA, 20 bp, Artificial Sequence
  Synthetic
tagtaagatgtggggccttt

SEQ ID NO: 627 - DNA, 20 bp, Artificial Sequence
  Synthetic
caactcctgaatagcacatt

SEQ ID NO: 628 - DNA, 20 bp, Artificial Sequence
  Synthetic
cgttaatccatatttaaact

SEQ ID NO: 629 - DNA, 20 bp, Artificial Sequence
  Synthetic
gctgggggaggggggagaca

SEQ ID NO: 630 - DNA, 20 bp, Artificial Sequence
  Synthetic
agaaggtttcagcgaagaca

SEQ ID NO: 631 - DNA, 20 bp, Artificial Sequence
  Synthetic
gaaacggaagtctgaggctg

SEQ ID NO: 632 - DNA, 20 bp, Artificial Sequence
  Synthetic
tctacgggaagatatcctgt

SEQ ID NO: 633 - DNA, 20 bp, Artificial Sequence
  Synthetic
gaaaaaaaaaaaaacaagtc

SEQ ID NO: 634 - DNA, 20 bp, Artificial Sequence
  Synthetic
agaaaaacttcacactgcta

SEQ ID NO: 635 - DNA, 20 bp, Artificial Sequence
  Synthetic
ttcttgctgaggaaagagga

SEQ ID NO: 636 - DNA, 20 bp, Artificial Sequence
  Synthetic
caggaattggctctgaaagc

SEQ ID NO: 637 - DNA, 20 bp, Artificial Sequence
  Synthetic
caaaagcagagcatctacat

SEQ ID NO: 638 - DNA, 20 bp, Artificial Sequence
  Synthetic
cccgctgctcaaacctctgg

SEQ ID NO: 639 - DNA, 20 bp, Artificial Sequence
  Synthetic
cacacttgccgtggccagcc

SEQ ID NO: 640 - DNA, 20 bp, Artificial Sequence
  Synthetic
acctatttttatagagatgg

SEQ ID NO: 641 - DNA, 20 bp, Artificial Sequence
  Synthetic
aggagggagggggcaggagc

SEQ ID NO: 642 - DNA, 20 bp, Artificial Sequence
  Synthetic
gtcgatccgtggttgcccag

SEQ ID NO: 643 - DNA, 20 bp, Artificial Sequence
  Synthetic
caagtggctggacgtgcaga

SEQ ID NO: 644 - DNA, 20 bp, Artificial Sequence
  Synthetic
ggatttctcttctttgtgat

SEQ ID NO: 645 - DNA, 20 bp, Artificial Sequence
  Synthetic
gcaattagggtctagttggc

SEQ ID NO: 646 - DNA, 20 bp, Artificial Sequence
  Synthetic
ggggggagacagggagaatg

SEQ ID NO: 647 - DNA, 20 bp, Artificial Sequence
  Synthetic
agagggtggggcctcaaagc

SEQ ID NO: 648 - DNA, 20 bp, Artificial Sequence
  Synthetic
ccatcccactgcctgctttg

SEQ ID NO: 649 - DNA, 20 bp, Artificial Sequence
  Synthetic
aagcaggcagtgggatggag

SEQ ID NO: 650 - DNA, 20 bp, Artificial Sequence
  Synthetic
ccccagaggtttgagcagcg

SEQ ID NO: 651 - DNA, 20 bp, Artificial Sequence
  Synthetic
cagggcatgcaagggaggtg

SEQ ID NO: 652 - DNA, 20 bp, Artificial Sequence
  Synthetic
ttttgttcgttatagaattt

SEQ ID NO: 653 - DNA, 20 bp, Artificial Sequence
  Synthetic
aaatatgattggaggatcaa

SEQ ID NO: 654 - DNA, 20 bp, Artificial Sequence
  Synthetic
ctgctggtttaaagcactga

SEQ ID NO: 655 - DNA, 20 bp, Artificial Sequence
  Synthetic
gattttcttgctgaggaaag

SEQ ID NO: 656 - DNA, 20 bp, Artificial Sequence
  Synthetic
catttgtctgtagacagcct

SEQ ID NO: 657 - DNA, 20 bp, Artificial Sequence
  Synthetic
atccgagggagagaagatgc

SEQ ID NO: 658 - DNA, 20 bp, Artificial Sequence
  Synthetic
ccaacattgcggtgtgaaga

SEQ ID NO: 659 - DNA, 20 bp, Artificial Sequence
  Synthetic
gtagtaagatgtggggcctt

SEQ ID NO: 660 - DNA, 20 bp, Artificial Sequence
  Synthetic
tcaactcctgaatagcacat

SEQ ID NO: 661 - DNA, 20 bp, Artificial Sequence
  Synthetic
agaaaataaattaaaaagca

SEQ ID NO: 662 - DNA, 20 bp, Artificial Sequence
  Synthetic
ccaaaggcaaggggtgttgg

SEQ ID NO: 663 - DNA, 20 bp, Artificial Sequence
  Synthetic
ttgatgttgacctaactgac

SEQ ID NO: 664 - DNA, 20 bp, Artificial Sequence
  Synthetic
ccttccgcccgccccgcaaa

SEQ ID NO: 665 - DNA, 20 bp, Artificial Sequence
  Synthetic
gctgccatttgcggggcggg

SEQ ID NO: 666 - DNA, 20 bp, Artificial Sequence
  Synthetic
ggatagagctgccatttgcg

SEQ ID NO: 667 - DNA, 20 bp, Artificial Sequence
  Synthetic
agcgaggaacatcacacact

SEQ ID NO: 668 - DNA, 20 bp, Artificial Sequence
  Synthetic
aatatgattggaggatcaaa

SEQ ID NO: 669 - DNA, 20 bp, Artificial Sequence
  Synthetic
attgaacccaggcgggcgga

SEQ ID NO: 670 - DNA, 20 bp, Artificial Sequence
  Synthetic
aagtctgaggctggggcaac

SEQ ID NO: 671 - DNA, 20 bp, Artificial Sequence
  Synthetic
gattacgcgtggcaggggtg

SEQ ID NO: 672 - DNA, 20 bp, Artificial Sequence
  Synthetic
taatctgcccgcagatcctg

SEQ ID NO: 673 - DNA, 20 bp, Artificial Sequence
  Synthetic
atagatagtatggaaaatta

SEQ ID NO: 674 - DNA, 20 bp, Artificial Sequence
  Synthetic
tggagaggagagaaagcccc

SEQ ID NO: 675 - DNA, 20 bp, Artificial Sequence
  Synthetic
agaggagagaaagcccctgg

SEQ ID NO: 676 - DNA, 20 bp, Artificial Sequence
  Synthetic
gggctatgcaggggctgcag

SEQ ID NO: 677 - DNA, 20 bp, Artificial Sequence
  Synthetic
ccagggcaaattggggtgta

SEQ ID NO: 678 - DNA, 20 bp, Artificial Sequence
  Synthetic
cgtgggccagtgggaaggtt

SEQ ID NO: 679 - DNA, 20 bp, Artificial Sequence
  Synthetic
ttggtgattaaatcattgtg

SEQ ID NO: 680 - DNA, 20 bp, Artificial Sequence
  Synthetic
tgtctcttgctagctcaaag

SEQ ID NO: 681 - DNA, 20 bp, Artificial Sequence
  Synthetic
gggcaagctagtgatactgg

SEQ ID NO: 682 - DNA, 20 bp, Artificial Sequence
  Synthetic
cttcaattaggaaaaaataa

SEQ ID NO: 683 - DNA, 20 bp, Artificial Sequence
  Synthetic
tagaaaataaattaaaaagc

SEQ ID NO: 684 - DNA, 20 bp, Artificial Sequence
  Synthetic
acctactgtgtgccctaccc

SEQ ID NO: 685 - DNA, 20 bp, Artificial Sequence
  Synthetic
gagtggcccttttggaccaa

SEQ ID NO: 686 - DNA, 20 bp, Artificial Sequence
  Synthetic
ataataaagtgtccttcaag

SEQ ID NO: 687 - DNA, 20 bp, Artificial Sequence
  Synthetic
ctccaccgtcaatagcattc

SEQ ID NO: 688 - DNA, 20 bp, Artificial Sequence
  Synthetic
atgttgctggtgggggtgca

SEQ ID NO: 689 - DNA, 20 bp, Artificial Sequence
  Synthetic
gtacttcgatgggctatgca

SEQ ID NO: 690 - DNA, 20 bp, Artificial Sequence
  Synthetic
ccccagccatgcacaaagat

SEQ ID NO: 691 - DNA, 20 bp, Artificial Sequence
  Synthetic
agtacctgggagagagggtg

SEQ ID NO: 692 - DNA, 20 bp, Artificial Sequence
  Synthetic
gttttgataggcacaggatg

SEQ ID NO: 693 - DNA, 20 bp, Artificial Sequence
  Synthetic
tctgtaacacacgcctgctg

SEQ ID NO: 694 - DNA, 20 bp, Artificial Sequence
  Synthetic
aatagcaaagtggttaaagg

SEQ ID NO: 695 - DNA, 20 bp, Artificial Sequence
  Synthetic
tatcatcagaaaagaaagaa

SEQ ID NO: 696 - DNA, 20 bp, Artificial Sequence
  Synthetic
gaatttaaattaattaaaat

SEQ ID NO: 697 - DNA, 20 bp, Artificial Sequence
  Synthetic
catatattagcagaaactga

SEQ ID NO: 698 - DNA, 20 bp, Artificial Sequence
  Synthetic
ggtggggaggtcacagaaca

SEQ ID NO: 699 - DNA, 20 bp, Artificial Sequence
  Synthetic
acaaatgctttctgcgggag

SEQ ID NO: 700 - DNA, 20 bp, Artificial Sequence
  Synthetic
agggcctcgtgggccatgtg

SEQ ID NO: 701 - DNA, 20 bp, Artificial Sequence
  Synthetic
cctgcgcaaaacgctttggc

SEQ ID NO: 702 - DNA, 20 bp, Artificial Sequence
  Synthetic
ccgctcccccaccccacgac

SEQ ID NO: 703 - DNA, 20 bp, Artificial Sequence
  Synthetic
taagtaccatatacataatg

SEQ ID NO: 704 - DNA, 20 bp, Artificial Sequence
  Synthetic
gtgtgttgggtgggagtggg

SEQ ID NO: 705 - DNA, 20 bp, Artificial Sequence
  Synthetic
aagaaaaaggtggactgaaa

SEQ ID NO: 706 - DNA, 20 bp, Artificial Sequence
  Synthetic
cgttttttaatggatccatg

SEQ ID NO: 707 - DNA, 20 bp, Artificial Sequence
  Synthetic
aatttgccctggatggtcct

SEQ ID NO: 708 - DNA, 20 bp, Artificial Sequence
  Synthetic
ggctggattctgactacact

SEQ ID NO: 709 - DNA, 20 bp, Artificial Sequence
  Synthetic
ctctcctgcgcaaaacgctt

SEQ ID NO: 710 - DNA, 20 bp, Artificial Sequence
  Synthetic
atctcggctcacaacaactt

SEQ ID NO: 711 - DNA, 20 bp, Artificial Sequence
  Synthetic
ttttgataggcacaggatgg

SEQ ID NO: 712 - DNA, 20 bp, Artificial Sequence
  Synthetic
aaagtggacagggcagggag

SEQ ID NO: 713 - DNA, 20 bp, Artificial Sequence
  Synthetic
aagaggtgaaaggaattcga

SEQ ID NO: 714 - DNA, 20 bp, Artificial Sequence
  Synthetic
agaccaaaggcaaggggtgt

SEQ ID NO: 715 - DNA, 20 bp, Artificial Sequence
  Synthetic
aaggttgcattggacactgc

SEQ ID NO: 716 - DNA, 20 bp, Artificial Sequence
  Synthetic
accacactgctgtctctcct

SEQ ID NO: 717 - DNA, 20 bp, Artificial Sequence
  Synthetic
aattaatatcgttgataaat

SEQ ID NO: 718 - DNA, 20 bp, Artificial Sequence
  Synthetic
atgctattaataattctgtt

SEQ ID NO: 719 - DNA, 20 bp, Artificial Sequence
  Synthetic
agggcaccatccagcctgtc

SEQ ID NO: 720 - DNA, 20 bp, Artificial Sequence
  Synthetic
tcataggctagtgtgtgtgt

SEQ ID NO: 721 - DNA, 20 bp, Artificial Sequence
  Synthetic
gaagatggaaggtcagtgtt

SEQ ID NO: 722 - DNA, 20 bp, Artificial Sequence
  Synthetic
ctgggggtggagcccgaggc

SEQ ID NO: 723 - DNA, 20 bp, Artificial Sequence
  Synthetic
ttctgtccctgtgagaaggc

SEQ ID NO: 724 - DNA, 20 bp, Artificial Sequence
  Synthetic
gtatgtcactgaagagagtc

SEQ ID NO: 725 - DNA, 20 bp, Artificial Sequence
  Synthetic
agtcgatccgtggttgccca

SEQ ID NO: 726 - DNA, 20 bp, Artificial Sequence
  Synthetic
cggcggaacgaggtggagtt

SEQ ID NO: 727 - DNA, 20 bp, Artificial Sequence
  Synthetic
ttgtttagaaattattttat

SEQ ID NO: 728 - DNA, 20 bp, Artificial Sequence
  Synthetic
gaggagaaattctgagcaga

SEQ ID NO: 729 - DNA, 20 bp, Artificial Sequence
  Synthetic
aaacattgtgtatgacggcg

SEQ ID NO: 730 - DNA, 20 bp, Artificial Sequence
  Synthetic
tggagaaaacacaaggaagt

SEQ ID NO: 731 - DNA, 20 bp, Artificial Sequence
  Synthetic
tgaagatggaaggtcagtgt

SEQ ID NO: 732 - DNA, 20 bp, Artificial Sequence
  Synthetic
tttaaaaatattgggtgtgg

SEQ ID NO: 733 - DNA, 20 bp, Artificial Sequence
  Synthetic
tagaaggctcctcacagaac

SEQ ID NO: 734 - DNA, 20 bp, Artificial Sequence
  Synthetic
ggtgtaacccaggaccatcc

SEQ ID NO: 735 - DNA, 20 bp, Artificial Sequence
  Synthetic
tttcttgctgaggaaagagg

SEQ ID NO: 736 - DNA, 20 bp, Artificial Sequence
  Synthetic
tctcttctttgtgattggca

SEQ ID NO: 737 - DNA, 20 bp, Artificial Sequence
  Synthetic
aatcgtctgattgctggaga

SEQ ID NO: 738 - DNA, 20 bp, Artificial Sequence
  Synthetic
cattgcggtgtgaagatgga

SEQ ID NO: 739 - DNA, 20 bp, Artificial Sequence
  Synthetic
tgtcgtggggtgggggagcg

SEQ ID NO: 740 - DNA, 20 bp, Artificial Sequence
  Synthetic
gcaagctagtgatactggag

SEQ ID NO: 741 - DNA, 20 bp, Artificial Sequence
  Synthetic
agttttgataggcacaggat

SEQ ID NO: 742 - DNA, 20 bp, Artificial Sequence
  Synthetic
tcaccatgggcatggtccag

SEQ ID NO: 743 - DNA, 20 bp, Artificial Sequence
  Synthetic
gggtacttgagaattgagag

SEQ ID NO: 744 - DNA, 20 bp, Artificial Sequence
  Synthetic
tttcactatttttcctttag

SEQ ID NO: 745 - DNA, 20 bp, Artificial Sequence
  Synthetic
ggaacagggactggtccttt

SEQ ID NO: 746 - DNA, 20 bp, Artificial Sequence
  Synthetic
tgtgttgggtgggagtgggt

SEQ ID NO: 747 - DNA, 20 bp, Artificial Sequence
  Synthetic
acaagcggctagatgtcgag

SEQ ID NO: 748 - DNA, 20 bp, Artificial Sequence
  Synthetic
gtgagtaaccagtggaacaa

SEQ ID NO: 749 - DNA, 20 bp, Artificial Sequence
  Synthetic
ttcatccagatgttagaaat

SEQ ID NO: 750 - DNA, 20 bp, Artificial Sequence
  Synthetic
cgtctgattgctggagaggg

SEQ ID NO: 751 - DNA, 20 bp, Artificial Sequence
  Synthetic
gaggggggagacagggagaa

SEQ ID NO: 752 - DNA, 20 bp, Artificial Sequence
  Synthetic
tcctgcgcaaaacgctttgg

SEQ ID NO: 753 - DNA, 20 bp, Artificial Sequence
  Synthetic
agtttaccaatctttgtgca

SEQ ID NO: 754 - DNA, 20 bp, Artificial Sequence
  Synthetic
gcatccctctggcccagggt

SEQ ID NO: 755 - DNA, 20 bp, Artificial Sequence
  Synthetic
gtgttgggtgggagtgggtg

SEQ ID NO: 756 - DNA, 20 bp, Artificial Sequence
  Synthetic
gaggccccaccctctctccc

SEQ ID NO: 757 - DNA, 20 bp, Artificial Sequence
  Synthetic
tctatcgtgcgctcttccgc

SEQ ID NO: 758 - DNA, 20 bp, Artificial Sequence
  Synthetic
tcattaattgttgcaactta

SEQ ID NO: 759 - DNA, 20 bp, Artificial Sequence
  Synthetic
ccaatccaagagactaaact

SEQ ID NO: 760 - DNA, 20 bp, Artificial Sequence
  Synthetic
gaacagggactggtcctttt

SEQ ID NO: 761 - DNA, 20 bp, Artificial Sequence
  Synthetic
gagacaagtctctctttagc

SEQ ID NO: 762 - DNA, 20 bp, Artificial Sequence
  Synthetic
ggtgagtaaccagtggaaca

SEQ ID NO: 763 - DNA, 20 bp, Artificial Sequence
  Synthetic
tgaccctttctctcctgaaa

SEQ ID NO: 764 - DNA, 20 bp, Artificial Sequence
  Synthetic
tgagaaagtatggcatattc

SEQ ID NO: 765 - DNA, 20 bp, Artificial Sequence
  Synthetic
atttgtctgtagacagcctg

SEQ ID NO: 766 - DNA, 20 bp, Artificial Sequence
  Synthetic
aagggggagcccagacaggc

SEQ ID NO: 767 - DNA, 20 bp, Artificial Sequence
  Synthetic
ctgaggctggggcaactggg

SEQ ID NO: 768 - DNA, 20 bp, Artificial Sequence
  Synthetic
gacggaggcaagagacagtc

SEQ ID NO: 769 - DNA, 20 bp, Artificial Sequence
  Synthetic
aagggctgtttttgtttcta

SEQ ID NO: 770 - DNA, 20 bp, Artificial Sequence
  Synthetic
gaacaacagttgtctttgtg

SEQ ID NO: 771 - DNA, 20 bp, Artificial Sequence
  Synthetic
aatccaacagaaaacaggat

SEQ ID NO: 772 - DNA, 20 bp, Artificial Sequence
  Synthetic
ctgactcaattataagacat

SEQ ID NO: 773 - DNA, 20 bp, Artificial Sequence
  Synthetic
ccatgggaaggaacgctcta

SEQ ID NO: 774 - DNA, 20 bp, Artificial Sequence
  Synthetic
cgcaggagagtggcggcatc

SEQ ID NO: 775 - DNA, 20 bp, Artificial Sequence
  Synthetic
ggcaagctagtgatactgga

SEQ ID NO: 776 - DNA, 20 bp, Artificial Sequence
  Synthetic
tttagtttgccgtctgtagg

SEQ ID NO: 777 - DNA, 20 bp, Artificial Sequence
  Synthetic
atggagttttggtggtgtag

SEQ ID NO: 778 - DNA, 20 bp, Artificial Sequence
  Synthetic
tgtagcaaagtggacagggc

SEQ ID NO: 779 - DNA, 20 bp, Artificial Sequence
  Synthetic
aaataatgattatctttttt

SEQ ID NO: 780 - DNA, 20 bp, Artificial Sequence
  Synthetic
gaccctttctctcctgaaat

SEQ ID NO: 781 - DNA, 20 bp, Artificial Sequence
  Synthetic
gtgaaagaaacggaagtctg

SEQ ID NO: 782 - DNA, 20 bp, Artificial Sequence
  Synthetic
gggtgggggtgtgaaagaaa

SEQ ID NO: 783 - DNA, 20 bp, Artificial Sequence
  Synthetic
gcatcataggggtgtggaaa

SEQ ID NO: 784 - DNA, 20 bp, Artificial Sequence
  Synthetic
atctgtgtaaaagagactcc

SEQ ID NO: 785 - DNA, 20 bp, Artificial Sequence
  Synthetic
ggctatgcaggggctgcagt

SEQ ID NO: 786 - DNA, 20 bp, Artificial Sequence
  Synthetic
aagtctgggaaatggagttt

SEQ ID NO: 787 - DNA, 20 bp, Artificial Sequence
  Synthetic
ggaattcgatggcccatttc

SEQ ID NO: 788 - DNA, 20 bp, Artificial Sequence
  Synthetic
ttatcttacttgcttaacgc

SEQ ID NO: 789 - DNA, 20 bp, Artificial Sequence
  Synthetic
gctgtgaggcagtttctgaa

SEQ ID NO: 790 - DNA, 20 bp, Artificial Sequence
  Synthetic
cggatgtctcatgtaacatg

SEQ ID NO: 791 - DNA, 20 bp, Artificial Sequence
  Synthetic
gggcaccatccagcctgtct

SEQ ID NO: 792 - DNA, 20 bp, Artificial Sequence
  Synthetic
ttatatgcatcataggggtg

SEQ ID NO: 793 - DNA, 20 bp, Artificial Sequence
  Synthetic
ctaccatcaaatatggcacc

SEQ ID NO: 794 - DNA, 20 bp, Artificial Sequence
  Synthetic
ttattgtatttcttgtagag

SEQ ID NO: 795 - DNA, 20 bp, Artificial Sequence
  Synthetic
tgccccctagcagatagtca

SEQ ID NO: 796 - DNA, 20 bp, Artificial Sequence
  Synthetic
tttctgcgggaggggagtct

SEQ ID NO: 797 - DNA, 20 bp, Artificial Sequence
  Synthetic
tggcgggtccctgttgccag

SEQ ID NO: 798 - DNA, 20 bp, Artificial Sequence
  Synthetic
tttgttcaaaatgtctggga

SEQ ID NO: 799 - DNA, 20 bp, Artificial Sequence
  Synthetic
tggctgggggctgctagtcc

SEQ ID NO: 800 - DNA, 20 bp, Artificial Sequence
  Synthetic
ccagctcgatttcaacactg

SEQ ID NO: 801 - DNA, 20 bp, Artificial Sequence
  Synthetic
caaactccacctcgttccgc

SEQ ID NO: 802 - DNA, 20 bp, Artificial Sequence
  Synthetic
tctgtgtaaaagagactcca

SEQ ID NO: 803 - DNA, 20 bp, Artificial Sequence
  Synthetic
gtgtaacccaggaccatcca

SEQ ID NO: 804 - DNA, 20 bp, Artificial Sequence
  Synthetic
taaattaaaaagcagggaga

SEQ ID NO: 805 - DNA, 20 bp, Artificial Sequence
  Synthetic
gctcttaaaagaagggacca

SEQ ID NO: 806 - DNA, 20 bp, Artificial Sequence
  Synthetic
tgtgccctaccctgggccag

SEQ ID NO: 807 - DNA, 20 bp, Artificial Sequence
  Synthetic
attataagacataggaagcc

SEQ ID NO: 808 - DNA, 20 bp, Artificial Sequence
  Synthetic
aatgaatttgagacgcctag

SEQ ID NO: 809 - DNA, 20 bp, Artificial Sequence
  Synthetic
aaacacttggagacagagcg

SEQ ID NO: 810 - DNA, 20 bp, Artificial Sequence
  Synthetic
gtctgcccaatgtgctattc

SEQ ID NO: 811 - DNA, 20 bp, Artificial Sequence
  Synthetic
tcatccctgactatctgcta

SEQ ID NO: 812 - DNA, 20 bp, Artificial Sequence
  Synthetic
agataagaaatagagaaaag

SEQ ID NO: 813 - DNA, 20 bp, Artificial Sequence
  Synthetic
aagaagttggctgggtgcag

SEQ ID NO: 814 - DNA, 20 bp, Artificial Sequence
  Synthetic
gcaaacattgtgtatgacgg

SEQ ID NO: 815 - DNA, 20 bp, Artificial Sequence
  Synthetic
ggcccacgttgcagggcacc

SEQ ID NO: 816 - DNA, 20 bp, Artificial Sequence
  Synthetic
acctagagtccaaggaagag

SEQ ID NO: 817 - DNA, 20 bp, Artificial Sequence
  Synthetic
gtctagaactacatgccaca

SEQ ID NO: 818 - DNA, 20 bp, Artificial Sequence
  Synthetic
ttttctcctggagtcgggct

SEQ ID NO: 819 - DNA, 20 bp, Artificial Sequence
  Synthetic
attccttccctccgggtata

SEQ ID NO: 820 - DNA, 20 bp, Artificial Sequence
  Synthetic
caaacattgtgtatgacggc

SEQ ID NO: 821 - DNA, 20 bp, Artificial Sequence
  Synthetic
ctttcataaccaaatccact

SEQ ID NO: 822 - DNA, 20 bp, Artificial Sequence
  Synthetic
tgtcacagcaggaaatttca

SEQ ID NO: 823 - DNA, 20 bp, Artificial Sequence
  Synthetic
cctcagctcaccatttgctc

SEQ ID NO: 824 - DNA, 20 bp, Artificial Sequence
  Synthetic
ggtgggaggatcatgagagt

SEQ ID NO: 825 - DNA, 20 bp, Artificial Sequence
  Synthetic
ggactcagcccctggcaaca

SEQ ID NO: 826 - DNA, 20 bp, Artificial Sequence
  Synthetic
tggggcctcaaagcaggcag

SEQ ID NO: 827 - DNA, 20 bp, Artificial Sequence
  Synthetic
cgtggggtgggggagcgggg

SEQ ID NO: 828 - DNA, 20 bp, Artificial Sequence
  Synthetic
ttctatggccagcttcagga

SEQ ID NO: 829 - DNA, 20 bp, Artificial Sequence
  Synthetic
agtaagatattttaatacga

SEQ ID NO: 830 - DNA, 20 bp, Artificial Sequence
  Synthetic
actgaaaaggccagagcaaa

SEQ ID NO: 831 - DNA, 20 bp, Artificial Sequence
  Synthetic
ctggtggccataggatggta

SEQ ID NO: 832 - DNA, 20 bp, Artificial Sequence
  Synthetic
gagaaaagaggccaggtgca

SEQ ID NO: 833 - DNA, 20 bp, Artificial Sequence
  Synthetic
tcttttagtttgccgtctgt

SEQ ID NO: 834 - DNA, 20 bp, Artificial Sequence
  Synthetic
tggtacttatactttgattg

SEQ ID NO: 835 - DNA, 20 bp, Artificial Sequence
  Synthetic
ctttctgcgggaggggagtc

SEQ ID NO: 836 - DNA, 20 bp, Artificial Sequence
  Synthetic
taatgaatttgagacgccta

SEQ ID NO: 837 - DNA, 20 bp, Artificial Sequence
  Synthetic
tcactgcctcagcagcgtgg

SEQ ID NO: 838 - DNA, 20 bp, Artificial Sequence
  Synthetic
aaaaaaagtggttgcagaac

SEQ ID NO: 839 - DNA, 20 bp, Artificial Sequence
  Synthetic
tctgggaaggccgggtgtgg

SEQ ID NO: 840 - DNA, 20 bp, Artificial Sequence
  Synthetic
ccagccaaaaatagccagtg

SEQ ID NO: 841 - DNA, 20 bp, Artificial Sequence
  Synthetic
ccacactggctatttttggc

SEQ ID NO: 842 - DNA, 20 bp, Artificial Sequence
  Synthetic
caattagggtctagttggct

SEQ ID NO: 843 - DNA, 20 bp, Artificial Sequence
  Synthetic
tgccagctcgatttcaacac

SEQ ID NO: 844 - DNA, 20 bp, Artificial Sequence
  Synthetic
gagctagcaagagacatcta

SEQ ID NO: 845 - DNA, 20 bp, Artificial Sequence
  Synthetic
actttttttgtgtccactgt

SEQ ID NO: 846 - DNA, 20 bp, Artificial Sequence
  Synthetic
ttaaatagcaaagtggttaa

SEQ ID NO: 847 - DNA, 20 bp, Artificial Sequence
  Synthetic
tgaggaaagaggagggggca

SEQ ID NO: 848 - DNA, 20 bp, Artificial Sequence
  Synthetic
ggggcctcaaagcaggcagt

SEQ ID NO: 849 - DNA, 20 bp, Artificial Sequence
  Synthetic
atagcaaagtggttaaagga

SEQ ID NO: 850 - DNA, 20 bp, Artificial Sequence
  Synthetic
attgtatttcttgtagagag

SEQ ID NO: 851 - DNA, 20 bp, Artificial Sequence
  Synthetic
agggcttccctaagcccaaa

SEQ ID NO: 852 - DNA, 20 bp, Artificial Sequence
  Synthetic
caggctgtcggagaagagtg

SEQ ID NO: 853 - DNA, 20 bp, Artificial Sequence
  Synthetic
ttcaaaatgtctgggaaggc

SEQ ID NO: 854 - DNA, 20 bp, Artificial Sequence
  Synthetic
tgatgttgacctaactgaca

SEQ ID NO: 855 - DNA, 20 bp, Artificial Sequence
  Synthetic
aatctaagattggtgactgg

SEQ ID NO: 856 - DNA, 20 bp, Artificial Sequence
  Synthetic
ccatttgcggggcgggcgga

SEQ ID NO: 857 - DNA, 20 bp, Artificial Sequence
  Synthetic
agtacttcgatgggctatgc

SEQ ID NO: 858 - DNA, 20 bp, Artificial Sequence
  Synthetic
ggttgttagactcagcactg

SEQ ID NO: 859 - DNA, 20 bp, Artificial Sequence
  Synthetic
cctctcgtgaaagagaaaga

SEQ ID NO: 860 - DNA, 20 bp, Artificial Sequence
  Synthetic
aggtagagtacctgggagag

SEQ ID NO: 861 - DNA, 20 bp, Artificial Sequence
  Synthetic
agctagcaagagacatctac

SEQ ID NO: 862 - DNA, 20 bp, Artificial Sequence
  Synthetic
gacagcagtgtggtggctgc

SEQ ID NO: 863 - DNA, 20 bp, Artificial Sequence
  Synthetic
tgagacaggccgatcacttg

SEQ ID NO: 864 - DNA, 20 bp, Artificial Sequence
  Synthetic
tgactactttaagatgcttt

SEQ ID NO: 865 - DNA, 20 bp, Artificial Sequence
  Synthetic
ttgccccctagcagatagtc

SEQ ID NO: 866 - DNA, 20 bp, Artificial Sequence
  Synthetic
aacgtcctctttatagggaa

SEQ ID NO: 867 - DNA, 20 bp, Artificial Sequence
  Synthetic
ctcagtttccttgtgtgtcc

SEQ ID NO: 868 - DNA, 20 bp, Artificial Sequence
  Synthetic
ttcctttcaagtgctgttaa

SEQ ID NO: 869 - DNA, 20 bp, Artificial Sequence
  Synthetic
caaaactccaagaccctagc

SEQ ID NO: 870 - DNA, 20 bp, Artificial Sequence
  Synthetic
ccaggctgtcggagaagagt

SEQ ID NO: 871 - DNA, 20 bp, Artificial Sequence
  Synthetic
gggtggccctgaatcttcct

SEQ ID NO: 872 - DNA, 20 bp, Artificial Sequence
  Synthetic
agcctcactctctgctcaca

SEQ ID NO: 873 - DNA, 20 bp, Artificial Sequence
  Synthetic
tatttccattttttacactc

SEQ ID NO: 874 - DNA, 20 bp, Artificial Sequence
  Synthetic
tttttgttattacttctctt

SEQ ID NO: 875 - DNA, 20 bp, Artificial Sequence
  Synthetic
gatggctttccagttctgtg

SEQ ID NO: 876 - DNA, 20 bp, Artificial Sequence
  Synthetic
ttcttcgcatcgcgggggtg

SEQ ID NO: 877 - DNA, 20 bp, Artificial Sequence
  Synthetic
acgatgttctctgctcttcg

SEQ ID NO: 878 - DNA, 20 bp, Artificial Sequence
  Synthetic
cttcatctgtttccatggga

SEQ ID NO: 879 - DNA, 20 bp, Artificial Sequence
  Synthetic
tcaacactggggtgtcccct

SEQ ID NO: 880 - DNA, 20 bp, Artificial Sequence
  Synthetic
gggtctatgctatgttaccc

SEQ ID NO: 881 - DNA, 20 bp, Artificial Sequence
  Synthetic
agagtacctgggagagaggg

SEQ ID NO: 882 - DNA, 20 bp, Artificial Sequence
  Synthetic
aggagccttctaaagttcaa

SEQ ID NO: 883 - DNA, 20 bp, Artificial Sequence
  Synthetic
gcttcaattaggaaaaaata

SEQ ID NO: 884 - DNA, 20 bp, Artificial Sequence
  Synthetic
ataaatctaagattggtgac

SEQ ID NO: 885 - DNA, 20 bp, Artificial Sequence
  Synthetic
actcaagggggagcccagac

SEQ ID NO: 886 - DNA, 20 bp, Artificial Sequence
  Synthetic
gtggaacttgaggatagacg

SEQ ID NO: 887 - DNA, 20 bp, Artificial Sequence
  Synthetic
gtagcaaagtggacagggca

SEQ ID NO: 888 - DNA, 20 bp, Artificial Sequence
  Synthetic
aggagaaattctgagcagat

SEQ ID NO: 889 - DNA, 20 bp, Artificial Sequence
  Synthetic
aataataaagtgtccttcaa

SEQ ID NO: 890 - DNA, 20 bp, Artificial Sequence
  Synthetic
ttggcgggtccctgttgcca

SEQ ID NO: 891 - DNA, 20 bp, Artificial Sequence
  Synthetic
aacagttgtctttgtgtgga

SEQ ID NO: 892 - DNA, 20 bp, Artificial Sequence
  Synthetic
ctacagacaaatgctttctg

SEQ ID NO: 893 - DNA, 20 bp, Artificial Sequence
  Synthetic
tgtaggcttggcgctatact

SEQ ID NO: 894 - DNA, 20 bp, Artificial Sequence
  Synthetic
ttgtggcacagtgagggaac

SEQ ID NO: 895 - DNA, 20 bp, Artificial Sequence
  Synthetic
cttaaagtagtcagagttac

SEQ ID NO: 896 - DNA, 20 bp, Artificial Sequence
  Synthetic
cttgtagtcccagctaccat

SEQ ID NO: 897 - DNA, 20 bp, Artificial Sequence
  Synthetic
gagcgaggaacatcacacac

SEQ ID NO: 898 - DNA, 20 bp, Artificial Sequence
  Synthetic
ctccagggagctagtgaaac

SEQ ID NO: 899 - DNA, 20 bp, Artificial Sequence
  Synthetic
ctcctgtttctcaagcagat

SEQ ID NO: 900 - DNA, 20 bp, Artificial Sequence
  Synthetic
ggcgcgctttagatacacac

SEQ ID NO: 901 - DNA, 20 bp, Artificial Sequence
  Synthetic
cataggctagtgtgtgtgtt

SEQ ID NO: 902 - DNA, 20 bp, Artificial Sequence
  Synthetic
tagaactacatgccacaggg

SEQ ID NO: 903 - DNA, 20 bp, Artificial Sequence
  Synthetic
catctcagggcatgcaaggg

SEQ ID NO: 904 - DNA, 20 bp, Artificial Sequence
  Synthetic
cggaatgctattgacggtgg

SEQ ID NO: 905 - DNA, 20 bp, Artificial Sequence
  Synthetic
ttcgcatcgcgggggtgggg

SEQ ID NO: 906 - DNA, 20 bp, Artificial Sequence
  Synthetic
atcagcaattagggtctagt

SEQ ID NO: 907 - DNA, 20 bp, Artificial Sequence
  Synthetic
atttgcggggcgggcggaag

SEQ ID NO: 908 - DNA, 20 bp, Artificial Sequence
  Synthetic
ggtggaagctaaaggaagat

SEQ ID NO: 909 - DNA, 20 bp, Artificial Sequence
  Synthetic
acttcttcgcatcgcggggg

SEQ ID NO: 910 - DNA, 20 bp, Artificial Sequence
  Synthetic
ctcctcattacagtgaaata

SEQ ID NO: 911 - DNA, 20 bp, Artificial Sequence
  Synthetic
ggagaaaagcatctcccttc

SEQ ID NO: 912 - DNA, 20 bp, Artificial Sequence
  Synthetic
tggtgattaaatcattgtgt

SEQ ID NO: 913 - DNA, 20 bp, Artificial Sequence
  Synthetic
ttttataattgtgatgataa

SEQ ID NO: 914 - DNA, 20 bp, Artificial Sequence
  Synthetic
atttaaattccaataccaca

SEQ ID NO: 915 - DNA, 20 bp, Artificial Sequence
  Synthetic
tgattgtgtcctctgtcccc

SEQ ID NO: 916 - DNA, 20 bp, Artificial Sequence
  Synthetic
ataatgaatttgagacgcct

SEQ ID NO: 917 - DNA, 20 bp, Artificial Sequence
  Synthetic
tgagaaacataaatcccgag

SEQ ID NO: 918 - DNA, 20 bp, Artificial Sequence
  Synthetic
gtgccctaccctgggccaga

SEQ ID NO: 919 - DNA, 20 bp, Artificial Sequence
  Synthetic
tgaaatgaactgtccagaac

SEQ ID NO: 920 - DNA, 20 bp, Artificial Sequence
  Synthetic
ccatagagcgttccttccca

SEQ ID NO: 921 - DNA, 20 bp, Artificial Sequence
  Synthetic
atgtctcatgtaacatgtgg

SEQ ID NO: 922 - DNA, 20 bp, Artificial Sequence
  Synthetic
tattattatatgcatcatag

SEQ ID NO: 923 - DNA, 20 bp, Artificial Sequence
  Synthetic
agagaaaagaggccaggtgc

SEQ ID NO: 924 - DNA, 20 bp, Artificial Sequence
  Synthetic
agcaatgtttactgggtggg

SEQ ID NO: 925 - DNA, 20 bp, Artificial Sequence
  Synthetic
cagtgttgggaagagtccat

SEQ ID NO: 926 - DNA, 20 bp, Artificial Sequence
  Synthetic
tgggacgacaggtgtaaccc

SEQ ID NO: 927 - DNA, 20 bp, Artificial Sequence
  Synthetic
ttcaaagattgagagggaat

SEQ ID NO: 928 - DNA, 20 bp, Artificial Sequence
  Synthetic
gggccagagggatgctccag

SEQ ID NO: 929 - DNA, 20 bp, Artificial Sequence
  Synthetic
catttgcggggcgggcggaa

SEQ ID NO: 930 - DNA, 20 bp, Artificial Sequence
  Synthetic
cactgctagggttaaatgaa

SEQ ID NO: 931 - DNA, 20 bp, Artificial Sequence
  Synthetic
aatacacatagaaaaatgac

SEQ ID NO: 932 - DNA, 20 bp, Artificial Sequence
  Synthetic
agacccatcctgttttctgt

SEQ ID NO: 933 - DNA, 20 bp, Artificial Sequence
  Synthetic
ctatgctatgttacccaggc

SEQ ID NO: 934 - DNA, 20 bp, Artificial Sequence
  Synthetic
ttgctggtgggggtgcaagg

SEQ ID NO: 935 - DNA, 20 bp, Artificial Sequence
  Synthetic
cactggttactcacccgcta

SEQ ID NO: 936 - DNA, 20 bp, Artificial Sequence
  Synthetic
caccacactgctgtctctcc

SEQ ID NO: 937 - DNA, 20 bp, Artificial Sequence
  Synthetic
gggactagtcatgactacat

SEQ ID NO: 938 - DNA, 20 bp, Artificial Sequence
  Synthetic
ttattagattccagtggtac

SEQ ID NO: 939 - DNA, 20 bp, Artificial Sequence
  Synthetic
ctacttagaaatataccttg

SEQ ID NO: 940 - DNA, 20 bp, Artificial Sequence
  Synthetic
tcgaacaatagactttcaat

SEQ ID NO: 941 - DNA, 20 bp, Artificial Sequence
  Synthetic
gacagggagaatggggagcg

SEQ ID NO: 942 - DNA, 20 bp, Artificial Sequence
  Synthetic
ccaacatcaccttctcagtg

SEQ ID NO: 943 - DNA, 20 bp, Artificial Sequence
  Synthetic
cctcaaagcaggcagtggga

SEQ ID NO: 944 - DNA, 20 bp, Artificial Sequence
  Synthetic
atcggggtatgtttacacaa

SEQ ID NO: 945 - DNA, 20 bp, Artificial Sequence
  Synthetic
tttcgtacaatactggaggc

SEQ ID NO: 946 - DNA, 20 bp, Artificial Sequence
  Synthetic
ttcgcccctagacactgccg

SEQ ID NO: 947 - DNA, 20 bp, Artificial Sequence
  Synthetic
tgccctgagatggggacaag

SEQ ID NO: 948 - DNA, 20 bp, Artificial Sequence
  Synthetic
gggagctagtgaaacaggaa

SEQ ID NO: 949 - DNA, 20 bp, Artificial Sequence
  Synthetic
aatcttaaatcatctaattg

SEQ ID NO: 950 - DNA, 20 bp, Artificial Sequence
  Synthetic
aaatccaacagaaaacagga

SEQ ID NO: 951 - DNA, 20 bp, Artificial Sequence
  Synthetic
atgtaaaccagttgtctgtt

SEQ ID NO: 952 - DNA, 20 bp, Artificial Sequence
  Synthetic
accaaatccacttggctcaa

SEQ ID NO: 953 - DNA, 20 bp, Artificial Sequence
  Synthetic
atcgaacaatagactttcaa

SEQ ID NO: 954 - DNA, 20 bp, Artificial Sequence
  Synthetic
aggctagtgtgtgtgttggg

SEQ ID NO: 955 - DNA, 20 bp, Artificial Sequence
  Synthetic
gggactcagcccctggcaac

SEQ ID NO: 956 - DNA, 20 bp, Artificial Sequence
  Synthetic
tttggcgggtccctgttgcc

SEQ ID NO: 957 - DNA, 20 bp, Artificial Sequence
  Synthetic
ttagctgagcgtggcagcgc

SEQ ID NO: 958 - DNA, 20 bp, Artificial Sequence
  Synthetic
agtctagaactacatgccac

SEQ ID NO: 959 - DNA, 20 bp, Artificial Sequence
  Synthetic
tgtcgagaggagcacattgg

SEQ ID NO: 960 - DNA, 20 bp, Artificial Sequence
  Synthetic
tgtggtagtagtaagatgtg

SEQ ID NO: 961 - DNA, 20 bp, Artificial Sequence
  Synthetic
actgctagggttaaatgaaa

SEQ ID NO: 962 - DNA, 20 bp, Artificial Sequence
  Synthetic
aaaaaatcctaacagacaac

SEQ ID NO: 963 - DNA, 20 bp, Artificial Sequence
  Synthetic
tgtggcacagtgagggaact

SEQ ID NO: 964 - DNA, 20 bp, Artificial Sequence
  Synthetic
taattaaaattggccgggcg

SEQ ID NO: 965 - DNA, 20 bp, Artificial Sequence
  Synthetic
ccaaaccggaatgctattga

SEQ ID NO: 966 - DNA, 20 bp, Artificial Sequence
  Synthetic
tctatttcttatctcctgag

SEQ ID NO: 967 - DNA, 20 bp, Artificial Sequence
  Synthetic
tctgtccctgtgagaaggca

SEQ ID NO: 968 - DNA, 20 bp, Artificial Sequence
  Synthetic
ctcggcttcatctgtttcca

SEQ ID NO: 969 - DNA, 20 bp, Artificial Sequence
  Synthetic
gagagttggaggctgcagtg

SEQ ID NO: 970 - DNA, 20 bp, Artificial Sequence
  Synthetic
taaaagagaaaccttgggcc

SEQ ID NO: 971 - DNA, 20 bp, Artificial Sequence
  Synthetic
tattccttccctccgggtat

SEQ ID NO: 972 - DNA, 20 bp, Artificial Sequence
  Synthetic
ccaaggtatatttctaagta

SEQ ID NO: 973 - DNA, 20 bp, Artificial Sequence
  Synthetic
caaaaatagccagtgtggct

SEQ ID NO: 974 - DNA, 20 bp, Artificial Sequence
  Synthetic
acagggagaatggggagcga

SEQ ID NO: 975 - DNA, 20 bp, Artificial Sequence
  Synthetic
aatattgggtgtggtggcac

SEQ ID NO: 976 - DNA, 20 bp, Artificial Sequence
  Synthetic
ttcctgtttcactagctccc

SEQ ID NO: 977 - DNA, 20 bp, Artificial Sequence
  Synthetic
aagtaccatatacataatgt

SEQ ID NO: 978 - DNA, 20 bp, Artificial Sequence
  Synthetic
aaattatgaatgattaaaaa

SEQ ID NO: 979 - DNA, 20 bp, Artificial Sequence
  Synthetic
ttcgtacaatactggaggct

SEQ ID NO: 980 - DNA, 20 bp, Artificial Sequence
  Synthetic
ataaaagagaaaccttgggc

SEQ ID NO: 981 - DNA, 20 bp, Artificial Sequence
  Synthetic
tgttttttattagattccag

SEQ ID NO: 982 - DNA, 20 bp, Artificial Sequence
  Synthetic
cctacttagaaatatacctt

SEQ ID NO: 983 - DNA, 20 bp, Artificial Sequence
  Synthetic
gcagagaacatcgtctctcc

SEQ ID NO: 984 - DNA, 20 bp, Artificial Sequence
  Synthetic
tgtcccctggagcatccctc

SEQ ID NO: 985 - DNA, 20 bp, Artificial Sequence
  Synthetic
ctctaaagatttgccagttc

SEQ ID NO: 986 - DNA, 20 bp, Artificial Sequence
  Synthetic
ttctcaagcagattggaagc

SEQ ID NO: 987 - DNA, 20 bp, Artificial Sequence
  Synthetic
ggtagagtacctgggagaga

SEQ ID NO: 988 - DNA, 20 bp, Artificial Sequence
  Synthetic
ccagggatgaagcaggaagc

SEQ ID NO: 989 - DNA, 20 bp, Artificial Sequence
  Synthetic
ccaaacccacggcagtgtct

SEQ ID NO: 990 - DNA, 20 bp, Artificial Sequence
  Synthetic
caggagagacagcagtgtgg

SEQ ID NO: 991 - DNA, 20 bp, Artificial Sequence
  Synthetic
gcctcactctctgctcacaa

SEQ ID NO: 992 - DNA, 20 bp, Artificial Sequence
  Synthetic
gaaaaatgacaggaaatgac

SEQ ID NO: 993 - DNA, 20 bp, Artificial Sequence
  Synthetic
caagccacactggctatttt

SEQ ID NO: 994 - DNA, 20 bp, Artificial Sequence
  Synthetic
tcggatgactgcactcacct

SEQ ID NO: 995 - DNA, 20 bp, Artificial Sequence
  Synthetic
agtaggttgccaagccacac

SEQ ID NO: 996 - DNA, 20 bp, Artificial Sequence
  Synthetic
actctcttcagtgacataca

SEQ ID NO: 997 - DNA, 20 bp, Artificial Sequence
  Synthetic
aaaagggccactctgctgtg

SEQ ID NO: 998 - DNA, 20 bp, Artificial Sequence
  Synthetic
atgttggagcaaagattcga

SEQ ID NO: 999 - DNA, 20 bp, Artificial Sequence
  Synthetic
caacatcaccttctcagtga

SEQ ID NO: 1000 - DNA, 20 bp, Artificial Sequence
  Synthetic
taataataaagtgtccttca

SEQ ID NO: 1001 - DNA, 20 bp, Artificial Sequence
  Synthetic
aaaaaagtggttgcagaaca

SEQ ID NO: 1002 - DNA, 20 bp, Artificial Sequence
  Synthetic
aatggagttttggtggtgta

SEQ ID NO: 1003 - DNA, 20 bp, Artificial Sequence
  Synthetic
ttaaagtagtcagagttact

SEQ ID NO: 1004 - DNA, 20 bp, Artificial Sequence
  Synthetic
ggtctaattttaaaatgctt

SEQ ID NO: 1005 - DNA, 20 bp, Artificial Sequence
  Synthetic
taaatgagaaaagcataaca

SEQ ID NO: 1006 - DNA, 20 bp, Artificial Sequence
  Synthetic
aattagggtctagttggctg

SEQ ID NO: 1007 - DNA, 20 bp, Artificial Sequence
  Synthetic
gggagcgagggcttaatgtt

SEQ ID NO: 1008 - DNA, 20 bp, Artificial Sequence
  Synthetic
tgtctttcgcttagcatatg

SEQ ID NO: 1009 - DNA, 20 bp, Artificial Sequence
  Synthetic
ttggagcaaagattcgaagg

SEQ ID NO: 1010 - DNA, 20 bp, Artificial Sequence
  Synthetic
ttaacacaattagctgagcg

SEQ ID NO: 1011 - DNA, 20 bp, Artificial Sequence
  Synthetic
ttgtacgaaataaatttctg

SEQ ID NO: 1012 - DNA, 20 bp, Artificial Sequence
  Synthetic
gaaagcaggcctctcttcct

SEQ ID NO: 1013 - DNA, 20 bp, Artificial Sequence
  Synthetic
catgagatgcatccaccctg

SEQ ID NO: 1014 - DNA, 20 bp, Artificial Sequence
  Synthetic
tcagcactgtggaagaaaca

SEQ ID NO: 1015 - DNA, 20 bp, Artificial Sequence
  Synthetic
cttcttcgcatcgcgggggt

SEQ ID NO: 1016 - DNA, 20 bp, Artificial Sequence
  Synthetic
aaccagtggaacaagggccc

SEQ ID NO: 1017 - DNA, 20 bp, Artificial Sequence
  Synthetic
cttccctccgggtatagggc

SEQ ID NO: 1018 - DNA, 20 bp, Artificial Sequence
  Synthetic
atccctgactatctgctagg

SEQ ID NO: 1019 - DNA, 20 bp, Artificial Sequence
  Synthetic
tcggcttcatctgtttccat

SEQ ID NO: 1020 - DNA, 20 bp, Artificial Sequence
  Synthetic
aggcaaagaaattctatgga

SEQ ID NO: 1021 - DNA, 20 bp, Artificial Sequence
  Synthetic
cctggtggccataggatggt

SEQ ID NO: 1022 - DNA, 20 bp, Artificial Sequence
  Synthetic
cagcgcgtggtccctgcctc

SEQ ID NO: 1023 - DNA, 20 bp, Artificial Sequence
  Synthetic
tgggggtggagcccgaggca

SEQ ID NO: 1024 - DNA, 20 bp, Artificial Sequence
  Synthetic
gagaaaccttgggccgggca

SEQ ID NO: 1025 - DNA, 20 bp, Artificial Sequence
  Synthetic
ctgactactttaagatgctt

SEQ ID NO: 1026 - DNA, 20 bp, Artificial Sequence
  Synthetic
gatggatggcgaagccactc

SEQ ID NO: 1027 - DNA, 20 bp, Artificial Sequence
  Synthetic
gctttggtggtaaaaaatac

SEQ ID NO: 1028 - DNA, 20 bp, Artificial Sequence
  Synthetic
cccaaggtatatttctaagt

SEQ ID NO: 1029 - DNA, 20 bp, Artificial Sequence
  Synthetic
ggctagtgtgtgtgttgggt

SEQ ID NO: 1030 - DNA, 20 bp, Artificial Sequence
  Synthetic
cctcagcctcccatggtagc

SEQ ID NO: 1031 - DNA, 20 bp, Artificial Sequence
  Synthetic
gcagcgcgtggtccctgcct

SEQ ID NO: 1032 - DNA, 20 bp, Artificial Sequence
  Synthetic
tattagattccagtggtact

SEQ ID NO: 1033 - DNA, 20 bp, Artificial Sequence
  Synthetic
gaaaacctagtttagtctct

SEQ ID NO: 1034 - DNA, 20 bp, Artificial Sequence
  Synthetic
ctggagtcgggcttggtagg

SEQ ID NO: 1035 - DNA, 20 bp, Artificial Sequence
  Synthetic
attaattaaaattggccggg

SEQ ID NO: 1036 - DNA, 20 bp, Artificial Sequence
  Synthetic
agattcattcattcattcct

SEQ ID NO: 1037 - DNA, 20 bp, Artificial Sequence
  Synthetic
ttcacttaggcgttggatga

SEQ ID NO: 1038 - DNA, 20 bp, Artificial Sequence
  Synthetic
tttgaggcaaagaaattcta

SEQ ID NO: 1039 - DNA, 20 bp, Artificial Sequence
  Synthetic
gagacagtctggcacatttg

SEQ ID NO: 1040 - DNA, 20 bp, Artificial Sequence
  Synthetic
ctcagcctcccatggtagct

SEQ ID NO: 1041 - DNA, 20 bp, Artificial Sequence
  Synthetic
ctcccttgcatgccctgaga

SEQ ID NO: 1042 - DNA, 20 bp, Artificial Sequence
  Synthetic
ttaattaaaattggccgggc

SEQ ID NO: 1043 - DNA, 20 bp, Artificial Sequence
  Synthetic
tagtcatgactagtcccatg

SEQ ID NO: 1044 - DNA, 20 bp, Artificial Sequence
  Synthetic
tagtcacatttctcagtatt

SEQ ID NO: 1045 - DNA, 20 bp, Artificial Sequence
  Synthetic
tgaggagacactgccactga

SEQ ID NO: 1046 - DNA, 20 bp, Artificial Sequence
  Synthetic
ctgagcaaacctagagtcca

SEQ ID NO: 1047 - DNA, 20 bp, Artificial Sequence
  Synthetic
agcttcaggagggagggggc

SEQ ID NO: 1048 - DNA, 20 bp, Artificial Sequence
  Synthetic
aacgtttctatcatcgcaga

SEQ ID NO: 1049 - DNA, 20 bp, Artificial Sequence
  Synthetic
tgtatgacggcggggcgcgg

SEQ ID NO: 1050 - DNA, 20 bp, Artificial Sequence
  Synthetic
tgggccagagggatgctcca

SEQ ID NO: 1051 - DNA, 20 bp, Artificial Sequence
  Synthetic
attagggtctagttggctgg

SEQ ID NO: 1052 - DNA, 20 bp, Artificial Sequence
  Synthetic
agaaaaatgacaggaaatga

SEQ ID NO: 1053 - DNA, 20 bp, Artificial Sequence
  Synthetic
gtgtgatattccttccctcc

SEQ ID NO: 1054 - DNA, 20 bp, Artificial Sequence
  Synthetic
ttgtgtatgacggcggggcg

SEQ ID NO: 1055 - DNA, 20 bp, Artificial Sequence
  Synthetic
ccaatctttgtgcatggctg

SEQ ID NO: 1056 - DNA, 20 bp, Artificial Sequence
  Synthetic
tgcaaaggaaatcagcaatt

SEQ ID NO: 1057 - DNA, 20 bp, Artificial Sequence
  Synthetic
agaaagcccctggtggccat

SEQ ID NO: 1058 - DNA, 20 bp, Artificial Sequence
  Synthetic
gctattaaaaaggatgaggt

SEQ ID NO: 1059 - DNA, 20 bp, Artificial Sequence
  Synthetic
tatggccagcttcaggaggg

SEQ ID NO: 1060 - DNA, 20 bp, Artificial Sequence
  Synthetic
ttatcagtcattttttgtat

SEQ ID NO: 1061 - DNA, 20 bp, Artificial Sequence
  Synthetic
ccataggatggtagggattt

SEQ ID NO: 1062 - DNA, 20 bp, Artificial Sequence
  Synthetic
ccactgaaggacagaagcag

SEQ ID NO: 1063 - DNA, 20 bp, Artificial Sequence
  Synthetic
agggtttcctcacagcagag

SEQ ID NO: 1064 - DNA, 20 bp, Artificial Sequence
  Synthetic
gccagctcgatttcaacact

SEQ ID NO: 1065 - DNA, 20 bp, Artificial Sequence
  Synthetic
aagttccacaaagcctcaca

SEQ ID NO: 1066 - DNA, 20 bp, Artificial Sequence
  Synthetic
attatcagtcattttttgta

SEQ ID NO: 1067 - DNA, 20 bp, Artificial Sequence
  Synthetic
ctatctccatgaccccttga

SEQ ID NO: 1068 - DNA, 20 bp, Artificial Sequence
  Synthetic
gactactttaagatgctttg

SEQ ID NO: 1069 - DNA, 20 bp, Artificial Sequence
  Synthetic
gactggtccttttgggctta

SEQ ID NO: 1070 - DNA, 20 bp, Artificial Sequence
  Synthetic
atgtggtagtagtaagatgt

SEQ ID NO: 1071 - DNA, 20 bp, Artificial Sequence
  Synthetic
tacatggcctttgagccaag

SEQ ID NO: 1072 - DNA, 20 bp, Artificial Sequence
  Synthetic
catcaaccggcggaacgagg

SEQ ID NO: 1073 - DNA, 20 bp, Artificial Sequence
  Synthetic
ggactggtccttttgggctt

SEQ ID NO: 1074 - DNA, 20 bp, Artificial Sequence
  Synthetic
tggtgtatctgcttcagcat

SEQ ID NO: 1075 - DNA, 20 bp, Artificial Sequence
  Synthetic
aaatattgggtgtggtggca

SEQ ID NO: 1076 - DNA, 20 bp, Artificial Sequence
  Synthetic
gaaacataaatcccgagagg

SEQ ID NO: 1077 - DNA, 20 bp, Artificial Sequence
  Synthetic
ctacctcctgcccacctctc

SEQ ID NO: 1078 - DNA, 20 bp, Artificial Sequence
  Synthetic
agatgtcgagaggagcacat

SEQ ID NO: 1079 - DNA, 20 bp, Artificial Sequence
  Synthetic
ctctgtaacacacgcctgct

SEQ ID NO: 1080 - DNA, 20 bp, Artificial Sequence
  Synthetic
ctgggccagagggatgctcc

SEQ ID NO: 1081 - DNA, 20 bp, Artificial Sequence
  Synthetic
aaaataggtttaaaaatatt

SEQ ID NO: 1082 - DNA, 20 bp, Artificial Sequence
  Synthetic
aaaccttgggccgggcatgg

SEQ ID NO: 1083 - DNA, 20 bp, Artificial Sequence
  Synthetic
cagagcaaatggtgagctga

SEQ ID NO: 1084 - DNA, 20 bp, Artificial Sequence
  Synthetic
accttcattgctacttgaga

SEQ ID NO: 1085 - DNA, 20 bp, Artificial Sequence
  Synthetic
ctagtttagtctcttggatt

SEQ ID NO: 1086 - DNA, 20 bp, Artificial Sequence
  Synthetic
agtctggcacatttgtggct

SEQ ID NO: 1087 - DNA, 20 bp, Artificial Sequence
  Synthetic
acatatgagcatttccagtt

SEQ ID NO: 1088 - DNA, 20 bp, Artificial Sequence
  Synthetic
ccctacttagaaatatacct

SEQ ID NO: 1089 - DNA, 20 bp, Artificial Sequence
  Synthetic
atatggtacctcagaacccc

SEQ ID NO: 1090 - DNA, 20 bp, Artificial Sequence
  Synthetic
gaaacccttgttgtcacagc

SEQ ID NO: 1091 - DNA, 20 bp, Artificial Sequence
  Synthetic
tggtggaagctaaaggaaga

SEQ ID NO: 1092 - DNA, 20 bp, Artificial Sequence
  Synthetic
catatgagcatttccagttt

SEQ ID NO: 1093 - DNA, 20 bp, Artificial Sequence
  Synthetic
tcgcccctagacactgccgt

SEQ ID NO: 1094 - DNA, 20 bp, Artificial Sequence
  Synthetic
catccctgactatctgctag

SEQ ID NO: 1095 - DNA, 20 bp, Artificial Sequence
  Synthetic
gcaaaggaaatcagcaatta

SEQ ID NO: 1096 - DNA, 20 bp, Artificial Sequence
  Synthetic
ccagagcaaatggtgagctg

SEQ ID NO: 1097 - DNA, 20 bp, Artificial Sequence
  Synthetic
tttgttttgttcaaaatgtc

SEQ ID NO: 1098 - DNA, 20 bp, Artificial Sequence
  Synthetic
gtgtcctgccctatacccgg

SEQ ID NO: 1099 - DNA, 20 bp, Artificial Sequence
  Synthetic
gtagacagcctggggttctg

SEQ ID NO: 1100 - DNA, 20 bp, Artificial Sequence
  Synthetic
taattttatgcttttcttct

SEQ ID NO: 1101 - DNA, 20 bp, Artificial Sequence
  Synthetic
ccccagtgttgaaatcgagc

SEQ ID NO: 1102 - DNA, 20 bp, Artificial Sequence
  Synthetic
tggggtttgcagaatgacct

SEQ ID NO: 1103 - DNA, 20 bp, Artificial Sequence
  Synthetic
cctaaatccctaccatccta

SEQ ID NO: 1104 - DNA, 20 bp, Artificial Sequence
  Synthetic
caaacccacggcagtgtcta

SEQ ID NO: 1105 - DNA, 20 bp, Artificial Sequence
  Synthetic
cagtggaagtgttaagtggc

SEQ ID NO: 1106 - DNA, 20 bp, Artificial Sequence
  Synthetic
gtgatgataaaggctttgtg

SEQ ID NO: 1107 - DNA, 20 bp, Artificial Sequence
  Synthetic
tatgggtttctataatctgt

SEQ ID NO: 1108 - DNA, 20 bp, Artificial Sequence
  Synthetic
actgctgtggagaaaacaca

SEQ ID NO: 1109 - DNA, 20 bp, Artificial Sequence
  Synthetic
ccccatctcagggcatgcaa

SEQ ID NO: 1110 - DNA, 20 bp, Artificial Sequence
  Synthetic
aatgtggtagtagtaagatg

SEQ ID NO: 1111 - DNA, 20 bp, Artificial Sequence
  Synthetic
tattatttcaaagattgaga

SEQ ID NO: 1112 - DNA, 20 bp, Artificial Sequence
  Synthetic
atattatttcaaagattgag

SEQ ID NO: 1113 - DNA, 20 bp, Artificial Sequence
  Synthetic
aaacccacggcagtgtctag

SEQ ID NO: 1114 - DNA, 20 bp, Artificial Sequence
  Synthetic
agggatgctccaggggacag

SEQ ID NO: 1115 - DNA, 20 bp, Artificial Sequence
  Synthetic
cagaggtgggactcagcccc

SEQ ID NO: 1116 - DNA, 20 bp, Artificial Sequence
  Synthetic
agcaacatatgacacagttc

SEQ ID NO: 1117 - DNA, 20 bp, Artificial Sequence
  Synthetic
agtgaggcttccatttcaga

SEQ ID NO: 1118 - DNA, 20 bp, Artificial Sequence
  Synthetic
ttcagggaagaagaggtgaa

SEQ ID NO: 1119 - DNA, 20 bp, Artificial Sequence
  Synthetic
tttcaggagagaaagggtca

SEQ ID NO: 1120 - DNA, 20 bp, Artificial Sequence
  Synthetic
tccccatctcagggcatgca

SEQ ID NO: 1121 - DNA, 20 bp, Artificial Sequence
  Synthetic
agcccctggtggccatagga

SEQ ID NO: 1122 - DNA, 20 bp, Artificial Sequence
  Synthetic
gaatcgtctgattgctggag

SEQ ID NO: 1123 - DNA, 20 bp, Artificial Sequence
  Synthetic
aagacataggaagccaggtg

SEQ ID NO: 1124 - DNA, 20 bp, Artificial Sequence
  Synthetic
gcctctcttccttggactct

SEQ ID NO: 1125 - DNA, 20 bp, Artificial Sequence
  Synthetic
ggagcgagggcttaatgttt

SEQ ID NO: 1126 - DNA, 20 bp, Artificial Sequence
  Synthetic
acattgcataaatctaagat

SEQ ID NO: 1127 - DNA, 20 bp, Artificial Sequence
  Synthetic
gggagcccagacaggctgga

SEQ ID NO: 1128 - DNA, 20 bp, Artificial Sequence
  Synthetic
aaacataaatcccgagaggt

SEQ ID NO: 1129 - DNA, 20 bp, Artificial Sequence
  Synthetic
tctacctcctgcccacctct

SEQ ID NO: 1130 - DNA, 20 bp, Artificial Sequence
  Synthetic
ggccatcaaccggcggaacg

SEQ ID NO: 1131 - DNA, 20 bp, Artificial Sequence
  Synthetic
aggcgttgagaggagtgcgc

SEQ ID NO: 1132 - DNA, 20 bp, Artificial Sequence
  Synthetic
tgtcctgccctatacccgga

SEQ ID NO: 1133 - DNA, 20 bp, Artificial Sequence
  Synthetic
atgctttggtaaacatttct

SEQ ID NO: 1134 - DNA, 20 bp, Artificial Sequence
  Synthetic
gtgggccatgtgaggctttg

SEQ ID NO: 1135 - DNA, 20 bp, Artificial Sequence
  Synthetic
ggcgggataatcacttgagc

SEQ ID NO: 1136 - DNA, 20 bp, Artificial Sequence
  Synthetic
ctggtgacaatataattcca

SEQ ID NO: 1137 - DNA, 20 bp, Artificial Sequence
  Synthetic
ggccagcttcaggagggagg

SEQ ID NO: 1138 - DNA, 20 bp, Artificial Sequence
  Synthetic
taggactgggccttctgaaa

SEQ ID NO: 1139 - DNA, 20 bp, Artificial Sequence
  Synthetic
tcccttgcatgccctgagat

SEQ ID NO: 1140 - DNA, 20 bp, Artificial Sequence
  Synthetic
gtccccttgtccccatctca

SEQ ID NO: 1141 - DNA, 20 bp, Artificial Sequence
  Synthetic
tgtgtgatattccttccctc

SEQ ID NO: 1142 - DNA, 20 bp, Artificial Sequence
  Synthetic
ctgccctatacccggaggga

SEQ ID NO: 1143 - DNA, 20 bp, Artificial Sequence
  Synthetic
cttaaaatccaacagaaaac

SEQ ID NO: 1144 - DNA, 20 bp, Artificial Sequence
  Synthetic
acataggaagccaggtgcgg

SEQ ID NO: 1145 - DNA, 20 bp, Artificial Sequence
  Synthetic
gtggcagtggaagtgttaag

SEQ ID NO: 1146 - DNA, 20 bp, Artificial Sequence
  Synthetic
cccttgcatgccctgagatg

SEQ ID NO: 1147 - DNA, 20 bp, Artificial Sequence
  Synthetic
ggtccccttgtccccatctc

SEQ ID NO: 1148 - DNA, 20 bp, Artificial Sequence
  Synthetic
ataaatcccgagaggtgggc

SEQ ID NO: 1149 - DNA, 20 bp, Artificial Sequence
  Synthetic
tatgagcatttccagtttgg

SEQ ID NO: 1150 - DNA, 20 bp, Artificial Sequence
  Synthetic
tatttgtaatacccccaaac

SEQ ID NO: 1151 - DNA, 20 bp, Artificial Sequence
  Synthetic
gcccaggagagacagcagtg

SEQ ID NO: 1152 - DNA, 20 bp, Artificial Sequence
  Synthetic
tcactttttaaatagcaaag

SEQ ID NO: 1153 - DNA, 20 bp, Artificial Sequence
  Synthetic
tctgtgctctgcaaatgacc

SEQ ID NO: 1154 - DNA, 20 bp, Artificial Sequence
  Synthetic
aggtcattctgcaaacccca

SEQ ID NO: 1155 - DNA, 20 bp, Artificial Sequence
  Synthetic
taggtttgtctataatgtac

SEQ ID NO: 1156 - DNA, 20 bp, Artificial Sequence
  Synthetic
accttctcaagtagcaatga

SEQ ID NO: 1157 - DNA, 20 bp, Artificial Sequence
  Synthetic
gtatgggtttctataatctg

SEQ ID NO: 1158 - DNA, 20 bp, Artificial Sequence
  Synthetic
taccaatctttgtgcatggc

SEQ ID NO: 1159 - DNA, 20 bp, Artificial Sequence
  Synthetic
gacgtgcagaaggcgttgag

SEQ ID NO: 1160 - DNA, 20 bp, Artificial Sequence
  Synthetic
ctcacttatctcaaggttca

SEQ ID NO: 1161 - DNA, 20 bp, Artificial Sequence
  Synthetic
ttcaggagagaaagggtcaa

SEQ ID NO: 1162 - DNA, 20 bp, Artificial Sequence
  Synthetic
taggacttcttcgcatcgcg

SEQ ID NO: 1163 - DNA, 20 bp, Artificial Sequence
  Synthetic
ctgctcttcgtggacatttc

SEQ ID NO: 1164 - DNA, 20 bp, Artificial Sequence
  Synthetic
agaaatagagaaaagaggcc

SEQ ID NO: 1165 - DNA, 20 bp, Artificial Sequence
  Synthetic
actggttactcacccgctat

SEQ ID NO: 1166 - DNA, 20 bp, Artificial Sequence
  Synthetic
aggacttcttcgcatcgcgg

SEQ ID NO: 1167 - DNA, 20 bp, Artificial Sequence
  Synthetic
caacacgaatctgaacaaac

SEQ ID NO: 1168 - DNA, 20 bp, Artificial Sequence
  Synthetic
agaagtgatatgcttcaatt

SEQ ID NO: 1169 - DNA, 20 bp, Artificial Sequence
  Synthetic
gataatcacttgagctgggg

SEQ ID NO: 1170 - DNA, 20 bp, Artificial Sequence
  Synthetic
atatgagcatttccagtttg

SEQ ID NO: 1171 - DNA, 20 bp, Artificial Sequence
  Synthetic
cgggataatcacttgagctg

SEQ ID NO: 1172 - DNA, 20 bp, Artificial Sequence
  Synthetic
cgggagaatcgtctgattgc

SEQ ID NO: 1173 - DNA, 20 bp, Artificial Sequence
  Synthetic
tcaccaaaggagaagcaaca

SEQ ID NO: 1174 - DNA, 20 bp, Artificial Sequence
  Synthetic
ggggaggaggatgatctgtt

SEQ ID NO: 1175 - DNA, 20 bp, Artificial Sequence
  Synthetic
cgttggatgaaggttcattt

SEQ ID NO: 1176 - DNA, 20 bp, Artificial Sequence
  Synthetic
aggtcaattctgcccatagc

SEQ ID NO: 1177 - DNA, 20 bp, Artificial Sequence
  Synthetic
atggccagcttcaggaggga

SEQ ID NO: 1178 - DNA, 20 bp, Artificial Sequence
  Synthetic
aaatttatttcgtacaatac

SEQ ID NO: 1179 - DNA, 20 bp, Artificial Sequence
  Synthetic
gaagagcgcacgatagacgc

SEQ ID NO: 1180 - DNA, 20 bp, Artificial Sequence
  Synthetic
ccactgcttctgtccttcag

SEQ ID NO: 1181 - DNA, 20 bp, Artificial Sequence
  Synthetic
caaagaaattctatggacgg

SEQ ID NO: 1182 - DNA, 20 bp, Artificial Sequence
  Synthetic
aaggatgaggtcgggtgcag

SEQ ID NO: 1183 - DNA, 20 bp, Artificial Sequence
  Synthetic
gatcaaagggtatgatctaa

SEQ ID NO: 1184 - DNA, 20 bp, Artificial Sequence
  Synthetic
ttttgtgtccactgtaggct

SEQ ID NO: 1185 - DNA, 20 bp, Artificial Sequence
  Synthetic
agggaaggaatatcacacag

SEQ ID NO: 1186 - DNA, 20 bp, Artificial Sequence
  Synthetic
ctaggacttcttcgcatcgc

SEQ ID NO: 1187 - DNA, 20 bp, Artificial Sequence
  Synthetic
accaatctttgtgcatggct

SEQ ID NO: 1188 - DNA, 20 bp, Artificial Sequence
  Synthetic
ttggcgacaacatattgtaa

SEQ ID NO: 1189 - DNA, 20 bp, Artificial Sequence
  Synthetic
tggccagcttcaggagggag

SEQ ID NO: 1190 - DNA, 20 bp, Artificial Sequence
  Synthetic
gggaggaggatgatctgttt

SEQ ID NO: 1191 - DNA, 20 bp, Artificial Sequence
  Synthetic
tagggaagccctcactgaga

SEQ ID NO: 1192 - DNA, 20 bp, Artificial Sequence
  Synthetic
aaggtcaattctgcccatag

SEQ ID NO: 1193 - DNA, 20 bp, Artificial Sequence
  Synthetic
atctaattgtggcacagtga

SEQ ID NO: 1194 - DNA, 20 bp, Artificial Sequence
  Synthetic
tactggaggggggcagcgcg

SEQ ID NO: 1195 - DNA, 20 bp, Artificial Sequence
  Synthetic
catctaattgtggcacagtg

SEQ ID NO: 1196 - DNA, 20 bp, Artificial Sequence
  Synthetic
gctctgaagcacttgaaatg

SEQ ID NO: 1197 - DNA, 20 bp, Artificial Sequence
  Synthetic
ctatgtcttataattgagtc

SEQ ID NO: 1198 - DNA, 20 bp, Artificial Sequence
  Synthetic
tttatttcgtacaatactgg

SEQ ID NO: 1199 - DNA, 20 bp, Artificial Sequence
  Synthetic
aatcccgagaggtgggcagg

SEQ ID NO: 1200 - DNA, 20 bp, Artificial Sequence
  Synthetic
gtatagcgccaagcctacag

SEQ ID NO: 1201 - DNA, 20 bp, Artificial Sequence
  Synthetic
aaccggaatgctattgacgg

SEQ ID NO: 1202 - DNA, 20 bp, Artificial Sequence
  Synthetic
ttgttttgttcaaaatgtct

SEQ ID NO: 1203 - DNA, 20 bp, Artificial Sequence
  Synthetic
tctaggacttcttcgcatcg

SEQ ID NO: 1204 - DNA, 20 bp, Artificial Sequence
  Synthetic
cctagtttagtctcttggat

SEQ ID NO: 1205 - DNA, 20 bp, Artificial Sequence
  Synthetic
tttaaattccaataccacat

SEQ ID NO: 1206 - DNA, 20 bp, Artificial Sequence
  Synthetic
agcatcctttgaactttaga

SEQ ID NO: 1207 - DNA, 20 bp, Artificial Sequence
  Synthetic
gcgggataatcacttgagct

SEQ ID NO: 1208 - DNA, 20 bp, Artificial Sequence
  Synthetic
actctgtaacacacgcctgc

SEQ ID NO: 1209 - DNA, 20 bp, Artificial Sequence
  Synthetic
aagcgttttgcgcaggagag

SEQ ID NO: 1210 - DNA, 20 bp, Artificial Sequence
  Synthetic
agagctttggccgaggacga

SEQ ID NO: 1211 - DNA, 20 bp, Artificial Sequence
  Synthetic
agagacagaaagtcgatccg

SEQ ID NO: 1212 - DNA, 20 bp, Artificial Sequence
  Synthetic
ctattaaaaaggatgaggtc

SEQ ID NO: 1213 - DNA, 20 bp, Artificial Sequence
  Synthetic
tgaaggacagaagcagtgga

SEQ ID NO: 1214 - DNA, 20 bp, Artificial Sequence
  Synthetic
ctgaaggacagaagcagtgg

SEQ ID NO: 1215 - DNA, 20 bp, Artificial Sequence
  Synthetic
taccttatttcactgtaatg

SEQ ID NO: 1216 - DNA, 20 bp, Artificial Sequence
  Synthetic
aattagacctgcccagttag

SEQ ID NO: 1217 - DNA, 20 bp, Artificial Sequence
  Synthetic
ctgatatccactaactgggc

SEQ ID NO: 1218 - DNA, 20 bp, Artificial Sequence
  Synthetic
attgctgatatccactaact

SEQ ID NO: 1219 - DNA, 20 bp, Artificial Sequence
  Synthetic
caggctgtcaggaggcatga

SEQ ID NO: 1220 - DNA, 20 bp, Artificial Sequence
  Synthetic
aaatatcttacttcattact

SEQ ID NO: 1221 - DNA, 20 bp, Artificial Sequence
  Synthetic
ttttctggtatgatactatt

SEQ ID NO: 1222 - DNA, 20 bp, Artificial Sequence
  Synthetic
ctggtatgatactattaggt

SEQ ID NO: 1223 - DNA, 20 bp, Artificial Sequence
  Synthetic
atctcttgatgaacagctac

SEQ ID NO: 1224 - DNA, 20 bp, Artificial Sequence
  Synthetic
gatgaacagctacaggcctg

SEQ ID NO: 1225 - DNA, 20 bp, Artificial Sequence
  Synthetic
acagctacaggcctgaggtt

SEQ ID NO: 1226 - DNA, 20 bp, Artificial Sequence
  Synthetic
ctacatgaactcctaacctc

SEQ ID NO: 1227 - DNA, 20 bp, Artificial Sequence
  Synthetic
gtccttcagcctcaacttat

SEQ ID NO: 1228 - DNA, 20 bp, Artificial Sequence
  Synthetic
cacctataagttgaggctga

SEQ ID NO: 1229 - DNA, 20 bp, Artificial Sequence
  Synthetic
acacagtcacctataagttg

SEQ ID NO: 1230 - DNA, 20 bp, Artificial Sequence
  Synthetic
tcgttaactccgcagagcac

SEQ ID NO: 1231 - DNA, 20 bp, Artificial Sequence
  Synthetic
cgttaactccgcagagcaca

SEQ ID NO: 1232 - DNA, 20 bp, Artificial Sequence
  Synthetic
ggatggtgccctgtgctctg

SEQ ID NO: 1233 - DNA, 20 bp, Artificial Sequence
  Synthetic
ctatccccagcacctaaagc

SEQ ID NO: 1234 - DNA, 20 bp, Artificial Sequence
  Synthetic
tatccccagcacctaaagct

SEQ ID NO: 1235 - DNA, 20 bp, Artificial Sequence
  Synthetic
ggtagggatttaggaaaaag

SEQ ID NO: 1236 - DNA, 20 bp, Artificial Sequence
  Synthetic
agggatttaggaaaaagagg

SEQ ID NO: 1237 - DNA, 20 bp, Artificial Sequence
  Synthetic
tttaggaaaaagaggaggct

SEQ ID NO: 1238 - DNA, 20 bp, Artificial Sequence
  Synthetic
aggaaaaagaggaggcttgg

SEQ ID NO: 1239 - DNA, 20 bp, Artificial Sequence
  Synthetic
gatcatctagcacatgtttt

SEQ ID NO: 1240 - DNA, 20 bp, Artificial Sequence
  Synthetic
ctagcacatgtttttggttt

SEQ ID NO: 1241 - DNA, 20 bp, Artificial Sequence
  Synthetic
tatctggtgggtagctactt

SEQ ID NO: 1242 - DNA, 20 bp, Artificial Sequence
  Synthetic
ggtgggtagctacttaggag

SEQ ID NO: 1243 - DNA, 20 bp, Artificial Sequence
  Synthetic
cctgcttcctgcttcatccc

SEQ ID NO: 1244 - DNA, 20 bp, Artificial Sequence
  Synthetic
gaaggtgccagggatgaagc

SEQ ID NO: 1245 - DNA, 20 bp, Artificial Sequence
  Synthetic
ttgccccttccgccatggga

SEQ ID NO: 1246 - DNA, 20 bp, Artificial Sequence
  Synthetic
cttgccccttccgccatggg

SEQ ID NO: 1247 - DNA, 20 bp, Artificial Sequence
  Synthetic
tagcttgccccttccgccat

SEQ ID NO: 1248 - DNA, 20 bp, Artificial Sequence
  Synthetic
ctagcttgccccttccgcca

SEQ ID NO: 1249 - DNA, 20 bp, Artificial Sequence
  Synthetic
actaacattcacatcatagc

SEQ ID NO: 1250 - DNA, 20 bp, Artificial Sequence
  Synthetic
ctaacattcacatcatagca

SEQ ID NO: 1251 - DNA, 20 bp, Artificial Sequence
  Synthetic
tcacatcatagcagggactc

SEQ ID NO: 1252 - DNA, 20 bp, Artificial Sequence
  Synthetic
catcatagcagggactctgg

SEQ ID NO: 1253 - DNA, 20 bp, Artificial Sequence
  Synthetic
gggagcgccatctttgtagc

SEQ ID NO: 1254 - DNA, 20 bp, Artificial Sequence
  Synthetic
tcaagtagcaatgaaggtta

SEQ ID NO: 1255 - DNA, 20 bp, Artificial Sequence
  Synthetic
ctcaagtagcaatgaaggtt

SEQ ID NO: 1256 - DNA, 20 bp, Artificial Sequence
  Synthetic
ggaagacctgtgcatttttg

SEQ ID NO: 1257 - DNA, 20 bp, Artificial Sequence
  Synthetic
aactgtccacaaaaatgcac

SEQ ID NO: 1258 - DNA, 20 bp, Artificial Sequence
  Synthetic
atttatttttagcagagaca

SEQ ID NO: 1259 - DNA, 20 bp, Artificial Sequence
  Synthetic
ggttggtgcaagagtaactg

SEQ ID NO: 1260 - DNA, 20 bp, Artificial Sequence
  Synthetic
atatcggctcactgcaaccc

SEQ ID NO: 1261 - DNA, 20 bp, Artificial Sequence
  Synthetic
agccagcatcttctctccct

SEQ ID NO: 1262 - DNA, 20 bp, Artificial Sequence
  Synthetic
cacctgtgatccgagctact

SEQ ID NO: 1263 - DNA, 20 bp, Artificial Sequence
  Synthetic
tactcgggggaggctgaagc

SEQ ID NO: 1264 - DNA, 20 bp, Artificial Sequence
  Synthetic
gaacgaggtggagtttggcc

SEQ ID NO: 1265 - DNA, 20 bp, Artificial Sequence
  Synthetic
gcatcactgcacctcagtct

SEQ ID NO: 1266 - DNA, 20 bp, Artificial Sequence
  Synthetic
tgggttttgccatattgctc

SEQ ID NO: 1267 - DNA, 20 bp, Artificial Sequence
  Synthetic
ctacttaggagtggaattgc

SEQ ID NO: 1268 - DNA, 20 bp, Artificial Sequence
  Synthetic
ttcagcctcccccgagtagc

SEQ ID NO: 1269 - DNA, 20 bp, Artificial Sequence
  Synthetic
cacttccactgccaccaccc

SEQ ID NO: 1270 - DNA, 20 bp, Artificial Sequence
  Synthetic
tgcatcactgcacctcagtc

SEQ ID NO: 1271 - DNA, 20 bp, Artificial Sequence
  Synthetic
tccacagccttgtcaacact

SEQ ID NO: 1272 - DNA, 20 bp, Artificial Sequence
  Synthetic
ctctgggggagcatacagac

SEQ ID NO: 1273 - DNA, 20 bp, Artificial Sequence
  Synthetic
tcccccagaggtttgagcag

SEQ ID NO: 1274 - DNA, 20 bp, Artificial Sequence
  Synthetic
agggagagaagatgctggct

SEQ ID NO: 1275 - DNA, 20 bp, Artificial Sequence
  Synthetic
tcttagcctaggaagattca

SEQ ID NO: 1276 - DNA, 20 bp, Artificial Sequence
  Synthetic
gtatctcagggttcttgcct

SEQ ID NO: 1277 - DNA, 20 bp, Artificial Sequence
  Synthetic
ctcaagtggtttgcccgcct

SEQ ID NO: 1278 - DNA, 20 bp, Artificial Sequence
  Synthetic
caaaaccagcctgagcaata

SEQ ID NO: 1279 - DNA, 20 bp, Artificial Sequence
  Synthetic
tgaggcgggtctatcacctg

SEQ ID NO: 1280 - DNA, 20 bp, Artificial Sequence
  Synthetic
tgcccaggggctgggggagg

SEQ ID NO: 1281 - DNA, 20 bp, Artificial Sequence
  Synthetic
cagccatgagccactgcgtc

SEQ ID NO: 1282 - DNA, 20 bp, Artificial Sequence
  Synthetic
taagatgtggggcctttggg

SEQ ID NO: 1283 - DNA, 20 bp, Artificial Sequence
  Synthetic
caaaaagtatctgggcatga

SEQ ID NO: 1284 - DNA, 20 bp, Artificial Sequence
  Synthetic
ttaaattaattaaaattggc

SEQ ID NO: 1285 - DNA, 20 bp, Artificial Sequence
  Synthetic
tggaagtgagcagagagaga

SEQ ID NO: 1286 - DNA, 20 bp, Artificial Sequence
  Synthetic
ccgtctgtatgctcccccag

SEQ ID NO: 1287 - DNA, 20 bp, Artificial Sequence
  Synthetic
cagcatttgggcacgaaggc

SEQ ID NO: 1288 - DNA, 20 bp, Artificial Sequence
  Synthetic
catgccctgagatggggaca

SEQ ID NO: 1289 - DNA, 20 bp, Artificial Sequence
  Synthetic
acttccactgccaccaccct

SEQ ID NO: 1290 - DNA, 20 bp, Artificial Sequence
  Synthetic
tttacagctgaggccccagc

SEQ ID NO: 1291 - DNA, 20 bp, Artificial Sequence
  Synthetic
atgccctgagatggggacaa

SEQ ID NO: 1292 - DNA, 20 bp, Artificial Sequence
  Synthetic
ttgaatgaatgaatgctttg

SEQ ID NO: 1293 - DNA, 20 bp, Artificial Sequence
  Synthetic
aatgcagcatttgggcacga

SEQ ID NO: 1294 - DNA, 20 bp, Artificial Sequence
  Synthetic
taaaattacaaaaatgatcc

SEQ ID NO: 1295 - DNA, 20 bp, Artificial Sequence
  Synthetic
ggaaggagctctcagcagat

SEQ ID NO: 1296 - DNA, 20 bp, Artificial Sequence
  Synthetic
aagtatctgggcatgatggc

SEQ ID NO: 1297 - DNA, 20 bp, Artificial Sequence
  Synthetic
tgccccgctgctcaaacctc

SEQ ID NO: 1298 - DNA, 20 bp, Artificial Sequence
  Synthetic
tgcagctattaaaaaggatg

SEQ ID NO: 1299 - DNA, 20 bp, Artificial Sequence
  Synthetic
acgccactgtactcccagcc

SEQ ID NO: 1300 - DNA, 20 bp, Artificial Sequence
  Synthetic
tattgtatttcttgtagaga

SEQ ID NO: 1301 - DNA, 20 bp, Artificial Sequence
  Synthetic
tgagtctcgctcagtcaccc

SEQ ID NO: 1302 - DNA, 20 bp, Artificial Sequence
  Synthetic
ttggcggaagaagacacaag

SEQ ID NO: 1303 - DNA, 20 bp, Artificial Sequence
  Synthetic
ccgagctacttggaagactg

SEQ ID NO: 1304 - DNA, 20 bp, Artificial Sequence
  Synthetic
aaggagctctcagcagatag

SEQ ID NO: 1305 - DNA, 20 bp, Artificial Sequence
  Synthetic
tgaagcacttgaaatgtggc

SEQ ID NO: 1306 - DNA, 20 bp, Artificial Sequence
  Synthetic
gaaggagctctcagcagata

SEQ ID NO: 1307 - DNA, 20 bp, Artificial Sequence
  Synthetic
ggagggaaggaatatcacac

SEQ ID NO: 1308 - DNA, 20 bp, Artificial Sequence
  Synthetic
gagggaaggaatatcacaca

SEQ ID NO: 1309 - DNA, 20 bp, Artificial Sequence
  Synthetic
tggccggacgcagtggctca

SEQ ID NO: 1310 - DNA, 20 bp, Artificial Sequence
  Synthetic
cgggtctatcacctgaggtc

SEQ ID NO: 1311 - DNA, 20 bp, Artificial Sequence
  Synthetic
tggctgtaattctaacactt

SEQ ID NO: 1312 - DNA, 20 bp, Artificial Sequence
  Synthetic
ggctgtaattctaacacttt

SEQ ID NO: 1313 - DNA, 20 bp, Artificial Sequence
  Synthetic
ggcttgagccctggagttca

SEQ ID NO: 1314 - DNA, 20 bp, Artificial Sequence
  Synthetic
cctctgggggagcatacaga

SEQ ID NO: 1315 - DNA, 20 bp, Artificial Sequence
  Synthetic
gggggagcatacagacgggc

SEQ ID NO: 1316 - DNA, 20 bp, Artificial Sequence
  Synthetic
agggtctcgccatgctgccc

SEQ ID NO: 1317 - DNA, 20 bp, Artificial Sequence
  Synthetic
atgagccactgcgtccggcc

SEQ ID NO: 1318 - DNA, 20 bp, Artificial Sequence
  Synthetic
gaggagaatcgattgaaccc

SEQ ID NO: 1319 - DNA, 20 bp, Artificial Sequence
  Synthetic
caaggcaggagtatcacctg

SEQ ID NO: 1320 - DNA, 20 bp, Artificial Sequence
  Synthetic
acaaaaggggccgggcgcgg

SEQ ID NO: 1321 - DNA, 20 bp, Artificial Sequence
  Synthetic
aaaaaggatgagttcatgta

SEQ ID NO: 1322 - DNA, 20 bp, Artificial Sequence
  Synthetic
ctgtcgtggggtgggggagc

SEQ ID NO: 1323 - DNA, 20 bp, Artificial Sequence
  Synthetic
cgccactgtactcccagcct

SEQ ID NO: 1324 - DNA, 20 bp, Artificial Sequence
  Synthetic
tgcccaggctgggagtacag

SEQ ID NO: 1325 - DNA, 20 bp, Artificial Sequence
  Synthetic
caaaaatacaaaaagtatct

SEQ ID NO: 1326 - DNA, 20 bp, Artificial Sequence
  Synthetic
acaaaaatacaaaaagtatc

SEQ ID NO: 1327 - DNA, 20 bp, Artificial Sequence
  Synthetic
cgggcaaaccacttgaggtc

SEQ ID NO: 1328 - DNA, 20 bp, Artificial Sequence
  Synthetic
ttgtatctttagtagagcca

SEQ ID NO: 1329 - DNA, 20 bp, Artificial Sequence
  Synthetic
aataaattagccggatgtgg

SEQ ID NO: 1330 - DNA, 20 bp, Artificial Sequence
  Synthetic
gagacagggtttcagcatgc

SEQ ID NO: 1331 - DNA, 20 bp, Artificial Sequence
  Synthetic
cccccagaggtttgagcagc

SEQ ID NO: 1332 - DNA, 20 bp, Artificial Sequence
  Synthetic
aaaaaaggatgagttcatgt

SEQ ID NO: 1333 - DNA, 20 bp, Artificial Sequence
  Synthetic
agcaccactgcactccagtg

SEQ ID NO: 1334 - DNA, 20 bp, Artificial Sequence
  Synthetic
caggtgtcctgccctatacc

SEQ ID NO: 1335 - DNA, 20 bp, Artificial Sequence
  Synthetic
gcttgtagtcccagctacca

SEQ ID NO: 1336 - DNA, 20 bp, Artificial Sequence
  Synthetic
gatgagttcatgtagggaca

SEQ ID NO: 1337 - DNA, 20 bp, Artificial Sequence
  Synthetic
ccatgggaggctgaggtgag

SEQ ID NO: 1338 - DNA, 20 bp, Artificial Sequence
  Synthetic
tatttatttttagcagagac

SEQ ID NO: 1339 - DNA, 20 bp, Artificial Sequence
  Synthetic
tttgtatctttagtagagcc

SEQ ID NO: 1340 - DNA, 20 bp, Artificial Sequence
  Synthetic
agacggggtttcaccaggtt

SEQ ID NO: 1341 - DNA, 20 bp, Artificial Sequence
  Synthetic
gggcttgcagaatgagtgca

SEQ ID NO: 1342 - DNA, 20 bp, Artificial Sequence
  Synthetic
ggcctgcttcagggaagaag

SEQ ID NO: 1343 - DNA, 20 bp, Artificial Sequence
  Synthetic
agggtttcagcatgctggcc

SEQ ID NO: 1344 - DNA, 20 bp, Artificial Sequence
  Synthetic
tgagaccagcctgcccaacc

SEQ ID NO: 1345 - DNA, 20 bp, Artificial Sequence
  Synthetic
caggcatgagctaccccgcc

SEQ ID NO: 1346 - DNA, 20 bp, Artificial Sequence
  Synthetic
aaaaaaaaaaaaacaagtct

SEQ ID NO: 1347 - DNA, 20 bp, Artificial Sequence
  Synthetic
ataaaataccataaactagg

SEQ ID NO: 1348 - DNA, 20 bp, Artificial Sequence
  Synthetic
gccggtaatcccagttactc

SEQ ID NO: 1349 - DNA, 20 bp, Artificial Sequence
  Synthetic
tgttaatttttttgtagaga

SEQ ID NO: 1350 - DNA, 20 bp, Artificial Sequence
  Synthetic
ctcaaacttctgagctcaag

SEQ ID NO: 1351 - DNA, 20 bp, Artificial Sequence
  Synthetic
atactatgcagctattaaaa

SEQ ID NO: 1352 - DNA, 20 bp, Artificial Sequence
  Synthetic
agaaaagaggccaggtgcag

SEQ ID NO: 1353 - DNA, 20 bp, Artificial Sequence
  Synthetic
gttaatttttttgtagagac

SEQ ID NO: 1354 - DNA, 20 bp, Artificial Sequence
  Synthetic
cttcaggaggccaaggccag

SEQ ID NO: 1355 - DNA, 20 bp, Artificial Sequence
  Synthetic
caaaaatgatccgggcgtgg

SEQ ID NO: 1356 - DNA, 20 bp, Artificial Sequence
  Synthetic
gcacaggatgggggcgtggt

SEQ ID NO: 1357 - DNA, 20 bp, Artificial Sequence
  Synthetic
ggtctggaactctcgacctc

SEQ ID NO: 1358 - DNA, 20 bp, Artificial Sequence
  Synthetic
tgccaaatagttttccaaag

SEQ ID NO: 1359 - DNA, 20 bp, Artificial Sequence
  Synthetic
cctgtcacatgagggtcttc

SEQ ID NO: 1360 - DNA, 20 bp, Artificial Sequence
  Synthetic
cctctaatcccagctactcg

SEQ ID NO: 1361 - DNA, 20 bp, Artificial Sequence
  Synthetic
ggctgggaagtccacgatca

SEQ ID NO: 1362 - DNA, 20 bp, Artificial Sequence
  Synthetic
cctgaagaccctcatgtgac

SEQ ID NO: 1363 - DNA, 20 bp, Artificial Sequence
  Synthetic
cggaagaagacacaagtggc

SEQ ID NO: 1364 - DNA, 20 bp, Artificial Sequence
  Synthetic
gcaggacacctgtcacatga

SEQ ID NO: 1365 - DNA, 20 bp, Artificial Sequence
  Synthetic
tgtcacatgagggtcttcag

SEQ ID NO: 1366 - DNA, 20 bp, Artificial Sequence
  Synthetic
cagcagataggggagccaga

SEQ ID NO: 1367 - DNA, 20 bp, Artificial Sequence
  Synthetic
gggttttcaccatgtttccc

SEQ ID NO: 1368 - DNA, 20 bp, Artificial Sequence
  Synthetic
ccccgagtagctgggattag

SEQ ID NO: 1369 - DNA, 20 bp, Artificial Sequence
  Synthetic
cacttgagctggggaggcgg

SEQ ID NO: 1370 - DNA, 20 bp, Artificial Sequence
  Synthetic
atcaaggtgccagcagattt

SEQ ID NO: 1371 - DNA, 20 bp, Artificial Sequence
  Synthetic
ctgtcacatgagggtcttca

SEQ ID NO: 1372 - DNA, 20 bp, Artificial Sequence
  Synthetic
gtccgtgggcacaggcctgg

SEQ ID NO: 1373 - DNA, 20 bp, Artificial Sequence
  Synthetic
ggcaggacacctgtcacatg

SEQ ID NO: 1374 - DNA, 20 bp, Artificial Sequence
  Synthetic
agcagataggggagccagaa

SEQ ID NO: 1375 - DNA, 20 bp, Artificial Sequence
  Synthetic
cgcttgtgtgtctgcctgct

SEQ ID NO: 1376 - DNA, 20 bp, Artificial Sequence
  Synthetic
ccggcatgcgccaccatgcc

SEQ ID NO: 1377 - DNA, 20 bp, Artificial Sequence
  Synthetic
ccagaccagcctggccaagg

SEQ ID NO: 1378 - DNA, 20 bp, Artificial Sequence
  Synthetic
cgtgggcacaggcctggggg

SEQ ID NO: 1379 - DNA, 20 bp, Artificial Sequence
  Synthetic
agaaaactgcagaagcagga

SEQ ID NO: 1380 - DNA, 20 bp, Artificial Sequence
  Synthetic
ctctaatcccagctactcgg

SEQ ID NO: 1381 - DNA, 20 bp, Artificial Sequence
  Synthetic
ggatgggggcgtggtgggcc

SEQ ID NO: 1382 - DNA, 20 bp, Artificial Sequence
  Synthetic
ctcaggtgatactcctgcct

SEQ ID NO: 1383 - DNA, 20 bp, Artificial Sequence
  Synthetic
ccaccttggccaggctggtc

SEQ ID NO: 1384 - DNA, 20 bp, Artificial Sequence
  Synthetic
gtcttgggaaatgcagcatt

SEQ ID NO: 1385 - DNA, 20 bp, Artificial Sequence
  Synthetic
ccaggcatggtggcgcatgc

SEQ ID NO: 1386 - DNA, 20 bp, Artificial Sequence
  Synthetic
cggaagaatcagatcacacg

SEQ ID NO: 1387 - DNA, 20 bp, Artificial Sequence
  Synthetic
ggggtttcaccaggttgggc

SEQ ID NO: 1388 - DNA, 20 bp, Artificial Sequence
  Synthetic
tcactgatggacgtttgggt

SEQ ID NO: 1389 - DNA, 20 bp, Artificial Sequence
  Synthetic
aacgtccatcagtgatagac

SEQ ID NO: 1390 - DNA, 20 bp, Artificial Sequence
  Synthetic
tctatcactgatggacgttt

SEQ ID NO: 1391 - DNA, 20 bp, Artificial Sequence
  Synthetic
gatgggggcgtggtgggcca

SEQ ID NO: 1392 - DNA, 20 bp, Artificial Sequence
  Synthetic
gcgaggaacatcacacactg

SEQ ID NO: 1393 - DNA, 20 bp, Artificial Sequence
  Synthetic
aatcacttgagctggggagg

SEQ ID NO: 1394 - DNA, 20 bp, Artificial Sequence
  Synthetic
caggagtatcacctgaggtc

SEQ ID NO: 1395 - DNA, 20 bp, Artificial Sequence
  Synthetic
gtggggtgggggagcgggga

SEQ ID NO: 1396 - DNA, 20 bp, Artificial Sequence
  Synthetic
tttcaccaggttgggcaggc

SEQ ID NO: 1397 - DNA, 20 bp, Artificial Sequence
  Synthetic
tcttgggaaatgcagcattt

SEQ ID NO: 1398 - DNA, 20 bp, Artificial Sequence
  Synthetic
gttccagaccagcctggcca

SEQ ID NO: 1399 - DNA, 20 bp, Artificial Sequence
  Synthetic
tctcgccatgctgcccaggc

SEQ ID NO: 1400 - DNA, 20 bp, Artificial Sequence
  Synthetic
tttcagcatgctggccaggc

SEQ ID NO: 1401 - DNA, 20 bp, Artificial Sequence
  Synthetic
gggggcgtggtgggccaggg

SEQ ID NO: 1402 - DNA, 20 bp, Artificial Sequence
  Synthetic
gtctatcactgatggacgtt

SEQ ID NO: 1403 - DNA, 20 bp, Artificial Sequence
  Synthetic
taacacaagccgcctacaga

SEQ ID NO: 1404 - DNA, 20 bp, Artificial Sequence
  Synthetic
aatagctgcatagtattcca

SEQ ID NO: 1405 - DNA, 20 bp, Artificial Sequence
  Synthetic
tcctgcctcaggctcccgag

SEQ ID NO: 1406 - DNA, 20 bp, Artificial Sequence
  Synthetic
ctagcaggcagacacacaag

SEQ ID NO: 1407 - DNA, 20 bp, Artificial Sequence
  Synthetic
gccactcgggagcctgaggc

SEQ ID NO: 1408 - DNA, 20 bp, Artificial Sequence
  Synthetic
aggtccgtgggcacaggcct

SEQ ID NO: 1409 - DNA, 20 bp, Artificial Sequence
  Synthetic
gcctcaggctcccgagtggc

SEQ ID NO: 1410 - DNA, 20 bp, Artificial Sequence
  Synthetic
cccagccactcgggagcctg

SEQ ID NO: 1411 - DNA, 20 bp, Artificial Sequence
  Synthetic
tgtagagacggggtttcacc

SEQ ID NO: 1412 - DNA, 20 bp, Artificial Sequence
  Synthetic
actgccactgtactccagcc

SEQ ID NO: 1413 - DNA, 20 bp, Artificial Sequence
  Synthetic
tctcaaacttctgagctcaa

SEQ ID NO: 1414 - DNA, 20 bp, Artificial Sequence
  Synthetic
gtctcaaacttctgagctca

SEQ ID NO: 1415 - DNA, 20 bp, Artificial Sequence
  Synthetic
cctcaggctcccgagtggct

SEQ ID NO: 1416 - DNA, 20 bp, Artificial Sequence
  Synthetic
aggcctgtgcccacggacct

SEQ ID NO: 1417 - DNA, 20 bp, Artificial Sequence
  Synthetic
acctgtaatcccagccacct

SEQ ID NO: 1418 - DNA, 20 bp, Artificial Sequence
  Synthetic
agagtctcgctgtgttgctc

SEQ ID NO: 1419 - DNA, 20 bp, Artificial Sequence
  Synthetic
taggtccgtgggcacaggcc

SEQ ID NO: 1420 - DNA, 20 bp, Artificial Sequence
  Synthetic
cacccccaggcctgtgccca

SEQ ID NO: 1421 - DNA, 20 bp, Artificial Sequence
  Synthetic
tcagcctcccccgagtagct

SEQ ID NO: 1422 - DNA, 20 bp, Artificial Sequence
  Synthetic
ggcacaggatgggggcgtgg

SEQ ID NO: 1423 - DNA, 20 bp, Artificial Sequence
  Synthetic
gcttgtgtgtctgcctgcta

SEQ ID NO: 1424 - DNA, 20 bp, Artificial Sequence
  Synthetic
cctctcacctcagcctccca

SEQ ID NO: 1425 - DNA, 20 bp, Artificial Sequence
  Synthetic
ataataaaataccataaact

SEQ ID NO: 1426 - DNA, 20 bp, Artificial Sequence
  Synthetic
cacctgtaatcccagccacc

SEQ ID NO: 1427 - DNA, 20 bp, Artificial Sequence
  Synthetic
cgtctgtaatcccagccact

SEQ ID NO: 1428 - DNA, 20 bp, Artificial Sequence
  Synthetic
aggagaatcacttgaaaccc

SEQ ID NO: 1429 - DNA, 20 bp, Artificial Sequence
  Synthetic
taatcccagctactcggggg

SEQ ID NO: 1430 - DNA, 20 bp, Artificial Sequence
  Synthetic
gggattacagccaccatgcc

SEQ ID NO: 1431 - DNA, 20 bp, Artificial Sequence
  Synthetic
ctggaactcctgacctcaag

SEQ ID NO: 1432 - DNA, 20 bp, Artificial Sequence
  Synthetic
tacttaggagtggaattgct

SEQ ID NO: 1433 - DNA, 20 bp, Artificial Sequence
  Synthetic
ggtccgtgggcacaggcctg

SEQ ID NO: 1434 - DNA, 20 bp, Artificial Sequence
  Synthetic
gagccaccatgcccggccca

SEQ ID NO: 1435 - DNA, 20 bp, Artificial Sequence
  Synthetic
cttactcttgtcgcccaggc

SEQ ID NO: 1436 - DNA, 20 bp, Artificial Sequence
  Synthetic
cctgtcgtggggtgggggag

SEQ ID NO: 1437 - DNA, 20 bp, Artificial Sequence
  Synthetic
aggaggtcgaggctgcagtg

SEQ ID NO: 1438 - DNA, 20 bp, Artificial Sequence
  Synthetic
ggaagaatcagatcacacgt

SEQ ID NO: 1439 - DNA, 20 bp, Artificial Sequence
  Synthetic
atacagacgggcaggctgtg

SEQ ID NO: 1440 - DNA, 20 bp, Artificial Sequence
  Synthetic
gagtggaattgctgggtcat

SEQ ID NO: 1441 - DNA, 20 bp, Artificial Sequence
  Synthetic
gcctgtcatcccagctacta

SEQ ID NO: 1442 - DNA, 20 bp, Artificial Sequence
  Synthetic
tttataagccacctagttta

SEQ ID NO: 1443 - DNA, 20 bp, Artificial Sequence
  Synthetic
gcatacagacgggcaggctg

SEQ ID NO: 1444 - DNA, 20 bp, Artificial Sequence
  Synthetic
tggtgggccagggtggtctt

SEQ ID NO: 1445 - DNA, 20 bp, Artificial Sequence
  Synthetic
tcactctgtcacccagactg

SEQ ID NO: 1446 - DNA, 20 bp, Artificial Sequence
  Synthetic
catacagacgggcaggctgt

SEQ ID NO: 1447 - DNA, 20 bp, Artificial Sequence
  Synthetic
aactgaacaatgaaaacact

SEQ ID NO: 1448 - DNA, 20 bp, Artificial Sequence
  Synthetic
cttactctgttgcccaggct

SEQ ID NO: 1449 - DNA, 20 bp, Artificial Sequence
  Synthetic
ggttttgaactcctgacctt

SEQ ID NO: 1450 - DNA, 20 bp, Artificial Sequence
  Synthetic
gtggtgggccagggtggtct

SEQ ID NO: 1451 - DNA, 20 bp, Artificial Sequence
  Synthetic
caggtgtgcaccaccatggc

SEQ ID NO: 1452 - DNA, 20 bp, Artificial Sequence
  Synthetic
tccctagtagctgggatgac

SEQ ID NO: 1453 - DNA, 20 bp, Artificial Sequence
  Synthetic
ttttgccatattgctcaggc

SEQ ID NO: 1454 - DNA, 20 bp, Artificial Sequence
  Synthetic
acttggaagactgaggtggg

SEQ ID NO: 1455 - DNA, 20 bp, Artificial Sequence
  Synthetic
ctcagcactttgggagggcg

SEQ ID NO: 1456 - DNA, 20 bp, Artificial Sequence
  Synthetic
gtgtctgcctgctagggtct

SEQ ID NO: 1457 - DNA, 20 bp, Artificial Sequence
  Synthetic
tgtcatcccagctactaggg

SEQ ID NO: 1458 - DNA, 20 bp, Artificial Sequence
  Synthetic
tgtgcccacggacctaggtg

SEQ ID NO: 1459 - DNA, 20 bp, Artificial Sequence
  Synthetic
gctacttggaagactgaggt

SEQ ID NO: 1460 - DNA, 20 bp, Artificial Sequence
  Synthetic
gccccgctgctcaaacctct

SEQ ID NO: 1461 - DNA, 20 bp, Artificial Sequence
  Synthetic
tctaacactttgggaggctg

SEQ ID NO: 1462 - DNA, 20 bp, Artificial Sequence
  Synthetic
tcacctaggtccgtgggcac

SEQ ID NO: 1463 - DNA, 20 bp, Artificial Sequence
  Synthetic
tcccaggtggctgggattac

SEQ ID NO: 1464 - DNA, 20 bp, Artificial Sequence
  Synthetic
agctacttggaagactgagg

SEQ ID NO: 1465 - DNA, 20 bp, Artificial Sequence
  Synthetic
caggccgatcacttgaggtc

SEQ ID NO: 1466 - DNA, 20 bp, Artificial Sequence
  Synthetic
cagacgtgtgccaccacgcc

SEQ ID NO: 1467 - DNA, 20 bp, Artificial Sequence
  Synthetic
gtctcaaattcctgggctca

SEQ ID NO: 1468 - DNA, 20 bp, Artificial Sequence
  Synthetic
actacaggtgtgcaccacca

SEQ ID NO: 1469 - DNA, 20 bp, Artificial Sequence
  Synthetic
gagacagggtttcaccacct

SEQ ID NO: 1470 - DNA, 20 bp, Artificial Sequence
  Synthetic
tgtaatcccagccacctggg

SEQ ID NO: 1471 - DNA, 20 bp, Artificial Sequence
  Synthetic
gactgtaatcccagcacttc

SEQ ID NO: 1472 - DNA, 20 bp, Artificial Sequence
  Synthetic
ctcaagcaatcctctggcct

SEQ ID NO: 1473 - DNA, 20 bp, Artificial Sequence
  Synthetic
tctcaaattcctgggctcaa

SEQ ID NO: 1474 - DNA, 20 bp, Artificial Sequence
  Synthetic
agggtttcaccaccttggcc

SEQ ID NO: 1475 - DNA, 20 bp, Artificial Sequence
  Synthetic
caggcgtgagcccctgcacc

SEQ ID NO: 1476 - DNA, 20 bp, Artificial Sequence
  Synthetic
ttgctcagggtggagtgcag

SEQ ID NO: 1477 - DNA, 20 bp, Artificial Sequence
  Synthetic
ataggcacaggatgggggcg

SEQ ID NO: 1478 - DNA, 20 bp, Artificial Sequence
  Synthetic
cactgcagccttgaactcca

SEQ ID NO: 1479 - DNA, 20 bp, Artificial Sequence
  Synthetic
gctactagggaggctgaggg

SEQ ID NO: 1480 - DNA, 20 bp, Artificial Sequence
  Synthetic
caggcacgcaccaccacatc

SEQ ID NO: 1481 - DNA, 20 bp, Artificial Sequence
  Synthetic
gccacctgggaggctgaggc

SEQ ID NO: 1482 - DNA, 20 bp, Artificial Sequence
  Synthetic
gaagactgcttgagcccagg

SEQ ID NO: 1483 - DNA, 20 bp, Artificial Sequence
  Synthetic
tcctgcctcagcctcccagg

SEQ ID NO: 1484 - DNA, 20 bp, Artificial Sequence
  Synthetic
taaataaataaaaattagcc

SEQ ID NO: 1485 - DNA, 20 bp, Artificial Sequence
  Synthetic
ttaatttttttgtagagacg

SEQ ID NO: 1486 - DNA, 20 bp, Artificial Sequence
  Synthetic
gcctcagcctcccaggtggc

SEQ ID NO: 1487 - DNA, 20 bp, Artificial Sequence
  Synthetic
ccctcagcctccctagtagc

SEQ ID NO: 1488 - DNA, 20 bp, Artificial Sequence
  Synthetic
aaaaaaaaaaaaaaagacat

SEQ ID NO: 1489 - DNA, 20 bp, Artificial Sequence
  Synthetic
aaaaaaaaagccaggcacag

SEQ ID NO: 1490 - DNA, 20 bp, Artificial Sequence
  Synthetic
cctgtcctcacctaggtccg

SEQ ID NO: 1491 - DNA, 20 bp, Artificial Sequence
  Synthetic
aacccgggagatggaggttg

SEQ ID NO: 1492 - DNA, 20 bp, Artificial Sequence
  Synthetic
gtctgtaatcccagccactc

SEQ ID NO: 1493 - DNA, 20 bp, Artificial Sequence
  Synthetic
gggtttcaacatatgaattt

SEQ ID NO: 1494 - DNA, 20 bp, Artificial Sequence
  Synthetic
ctgtcctcacctaggtccgt

SEQ ID NO: 1495 - DNA, 20 bp, Artificial Sequence
  Synthetic
ccacggacctaggtgaggac

SEQ ID NO: 1496 - DNA, 20 bp, Artificial Sequence
  Synthetic
tcttgctctgtcacccacac

SEQ ID NO: 1497 - DNA, 20 bp, Artificial Sequence
  Synthetic
tcttaagtagctgggactac

SEQ ID NO: 1498 - DNA, 20 bp, Artificial Sequence
  Synthetic
tcaccacaacctccatctcc

SEQ ID NO: 1499 - DNA, 20 bp, Artificial Sequence
  Synthetic
ccagctactagggaggctga

SEQ ID NO: 1500 - DNA, 20 bp, Artificial Sequence
  Synthetic
aggagtgcctgtcctcacct

SEQ ID NO: 1501 - DNA, 20 bp, Artificial Sequence
  Synthetic
caccacaacctccatctccc

SEQ ID NO: 1502 - DNA, 20 bp, Artificial Sequence
  Synthetic
gttactcaggaagctgaggc

SEQ ID NO: 1503 - DNA, 20 bp, Artificial Sequence
  Synthetic
tgtagtcccagctacttaag

SEQ ID NO: 1504 - DNA, 20 bp, Artificial Sequence
  Synthetic
ccagaggattgcttgagccc

SEQ ID NO: 1505 - DNA, 20 bp, Artificial Sequence
  Synthetic
ggcttgagcctgggaggttg

SEQ ID NO: 1506 - DNA, 20 bp, Artificial Sequence
  Synthetic
gatcaaggtgccagcagatt

SEQ ID NO: 1507 - DNA, 20 bp, Artificial Sequence
  Synthetic
cctcagcctcccaggtggct

SEQ ID NO: 1508 - DNA, 20 bp, Artificial Sequence
  Synthetic
gggaggctgaggtgagagga

SEQ ID NO: 1509 - DNA, 20 bp, Artificial Sequence
  Synthetic
cccagccacctgggaggctg

SEQ ID NO: 1510 - DNA, 20 bp, Artificial Sequence
  Synthetic
acaggtgcagcacaccaaca

SEQ ID NO: 1511 - DNA, 20 bp, Artificial Sequence
  Synthetic
gcaccactgcactccagtgt

SEQ ID NO: 1512 - DNA, 20 bp, Artificial Sequence
  Synthetic
gcctcagcttcctgagtaac

SEQ ID NO: 1513 - DNA, 20 bp, Artificial Sequence
  Synthetic
tgagaggatggcttgagccc

SEQ ID NO: 1514 - DNA, 20 bp, Artificial Sequence
  Synthetic
tgtaattctaacactttggg

SEQ ID NO: 1515 - DNA, 20 bp, Artificial Sequence
  Synthetic
cctgggctcaagcaatcctc

SEQ ID NO: 1516 - DNA, 20 bp, Artificial Sequence
  Synthetic
gagccagggtttcaccatgt

SEQ ID NO: 1517 - DNA, 20 bp, Artificial Sequence
  Synthetic
gagaatcgattgaacccagg

SEQ ID NO: 1518 - DNA, 20 bp, Artificial Sequence
  Synthetic
ggtttcaacatatgaatttt

SEQ ID NO: 1519 - DNA, 20 bp, Artificial Sequence
  Synthetic
ggagtgcagtggtgcaatat

SEQ ID NO: 1520 - DNA, 20 bp, Artificial Sequence
  Synthetic
atacaaaaattagccggcca

SEQ ID NO: 1521 - DNA, 20 bp, Artificial Sequence
  Synthetic
cccagttactcaggaagctg

SEQ ID NO: 1522 - DNA, 20 bp, Artificial Sequence
  Synthetic
caaaaattagccggccatgg

SEQ ID NO: 1523 - DNA, 20 bp, Artificial Sequence
  Synthetic
aaataaaaattagccaggtg

SEQ ID NO: 1524 - DNA, 20 bp, Artificial Sequence
  Synthetic
caggtgcataccaccacacc

SEQ ID NO: 1525 - DNA, 20 bp, Artificial Sequence
  Synthetic
gcactttgggaagctgagac

SEQ ID NO: 1526 - DNA, 20 bp, Artificial Sequence
  Synthetic
cctcagcttcctgagtaact

SEQ ID NO: 1527 - DNA, 20 bp, Artificial Sequence
  Synthetic
ctttgggagggcgaggtggg

SEQ ID NO: 1528 - DNA, 20 bp, Artificial Sequence
  Synthetic
gctacttaagaggctgaggc

SEQ ID NO: 1529 - DNA, 20 bp, Artificial Sequence
  Synthetic
tgggaagactgcttgagccc

SEQ ID NO: 1530 - DNA, 20 bp, Artificial Sequence
  Synthetic
gtttcaacatatgaattttg

SEQ ID NO: 1531 - DNA, 20 bp, Artificial Sequence
  Synthetic
gcctcagcctcttaagtagc

SEQ ID NO: 1532 - DNA, 20 bp, Artificial Sequence
  Synthetic
caaggcaggtggatcaccta

SEQ ID NO: 1533 - DNA, 20 bp, Artificial Sequence
  Synthetic
ttcaacatatgaattttggg

SEQ ID NO: 1534 - DNA, 20 bp, Artificial Sequence
  Synthetic
ctgccactgtactccagcct

SEQ ID NO: 1535 - DNA, 20 bp, Artificial Sequence
  Synthetic
ttgtgttttttgtagagaca

SEQ ID NO: 1536 - DNA, 20 bp, Artificial Sequence
  Synthetic
tttcaccaccttggccaggc

SEQ ID NO: 1537 - DNA, 20 bp, Artificial Sequence
  Synthetic
tctcgctcagtcacccaggc

SEQ ID NO: 1538 - DNA, 20 bp, Artificial Sequence
  Synthetic
tgcatttcccaagaccaccc

SEQ ID NO: 1539 - DNA, 20 bp, Artificial Sequence
  Synthetic
tctttctttcttttttgaga

SEQ ID NO: 1540 - DNA, 20 bp, Artificial Sequence
  Synthetic
cctcagtcttccaagtagct

SEQ ID NO: 1541 - DNA, 20 bp, Artificial Sequence
  Synthetic
ctttgggaggacaaggcagg

SEQ ID NO: 1542 - DNA, 20 bp, Artificial Sequence
  Synthetic
gagtgcaaggttttattgag

SEQ ID NO: 1543 - DNA, 20 bp, Artificial Sequence
  Synthetic
gtaatctcagcactttggga

SEQ ID NO: 1544 - DNA, 20 bp, Artificial Sequence
  Synthetic
caaacattagccaggcatgg

SEQ ID NO: 1545 - DNA, 20 bp, Artificial Sequence
  Synthetic
tgagaccagcctgggcagca

SEQ ID NO: 1546 - DNA, 20 bp, Artificial Sequence
  Synthetic
atacaaacattagccaggca

SEQ ID NO: 1547 - DNA, 20 bp, Artificial Sequence
  Synthetic
tattattattattttgagac

SEQ ID NO: 1548 - DNA, 20 bp, Artificial Sequence
  Synthetic
cccagctacttaagaggctg

SEQ ID NO: 1549 - DNA, 20 bp, Artificial Sequence
  Synthetic
tcacccacactggagtgcag

SEQ ID NO: 1550 - DNA, 20 bp, Artificial Sequence
  Synthetic
gcactttgggagggcgaggt

SEQ ID NO: 1551 - DNA, 20 bp, Artificial Sequence
  Synthetic
gagacagggttttgctatgt

SEQ ID NO: 1552 - DNA, 20 bp, Artificial Sequence
  Synthetic
cctcagcctcttaagtagct

SEQ ID NO: 1553 - DNA, 20 bp, Artificial Sequence
  Synthetic
agggttttgctatgttggcc

SEQ ID NO: 1554 - DNA, 20 bp, Artificial Sequence
  Synthetic
tttgtgttttttgtagagac

SEQ ID NO: 1555 - DNA, 20 bp, Artificial Sequence
  Synthetic
tttcaacatatgaattttgg

SEQ ID NO: 1556 - DNA, 20 bp, Artificial Sequence
  Synthetic
ggggcctttgggaggtgatt

SEQ ID NO: 1557 - DNA, 20 bp, Artificial Sequence
  Synthetic
agtggaattgctgggtcata

SEQ ID NO: 1558 - DNA, 20 bp, Artificial Sequence
  Synthetic
cactgtagcctcaacctccc

SEQ ID NO: 1559 - DNA, 20 bp, Artificial Sequence
  Synthetic
caaaaaacacaaaaattagc

SEQ ID NO: 1560 - DNA, 20 bp, Artificial Sequence
  Synthetic
ggagtacaatggcgcgatct

SEQ ID NO: 1561 - DNA, 20 bp, Artificial Sequence
  Synthetic
ttttttttttcttttgagac

SEQ ID NO: 1562 - DNA, 20 bp, Artificial Sequence
  Synthetic
tggccaacatggtgaaaccc

SEQ ID NO: 1563 - DNA, 20 bp, Artificial Sequence
  Synthetic
cgcttgaacccggaaggcag

SEQ ID NO: 1564 - DNA, 20 bp, Artificial Sequence
  Synthetic
gagacggggtttcaccaggt

SEQ ID NO: 1565 - DNA, 20 bp, Artificial Sequence
  Synthetic
tggggcctgtcgtggggtgg

SEQ ID NO: 1566 - DNA, 20 bp, Artificial Sequence
  Synthetic
tctcagcttcccaaagtgct

SEQ ID NO: 1567 - DNA, 20 bp, Artificial Sequence
  Synthetic
ctggggcctgtcgtggggtg

SEQ ID NO: 1568 - DNA, 20 bp, Artificial Sequence
  Synthetic
cgtttgaacctgggaggcgg

SEQ ID NO: 1569 - DNA, 20 bp, Artificial Sequence
  Synthetic
cactggggcctgtcgtgggg

SEQ ID NO: 1570 - DNA, 20 bp, Artificial Sequence
  Synthetic
aactcctgacctcaagtgat

SEQ ID NO: 1571 - DNA, 20 bp, Artificial Sequence
  Synthetic
caggctggtcttgagctcct

SEQ ID NO: 1572 - DNA, 20 bp, Artificial Sequence
  Synthetic
cgcgccattgtactccagcc

SEQ ID NO: 1573 - DNA, 20 bp, Artificial Sequence
  Synthetic
cgcttgaacccgggagatgg

SEQ ID NO: 1574 - DNA, 20 bp, Artificial Sequence
  Synthetic
agagtcttactctgtcgccc

SEQ ID NO: 1575 - DNA, 20 bp, Artificial Sequence
  Synthetic
aagaggctgaggcaggagaa

SEQ ID NO: 1576 - DNA, 20 bp, Artificial Sequence
  Synthetic
aaaaaacacaaaaattagct

SEQ ID NO: 1577 - DNA, 20 bp, Artificial Sequence
  Synthetic
actggggcctgtcgtggggt

SEQ ID NO: 1578 - DNA, 20 bp, Artificial Sequence
  Synthetic
gcactttgggaggacaaggc

SEQ ID NO: 1579 - DNA, 20 bp, Artificial Sequence
  Synthetic
gccttggcctcctgaagtgc

SEQ ID NO: 1580 - DNA, 20 bp, Artificial Sequence
  Synthetic
gccttgtcctcccaaagtgc

SEQ ID NO: 1581 - DNA, 20 bp, Artificial Sequence
  Synthetic
agcactttgggagggcgagg

SEQ ID NO: 1582 - DNA, 20 bp, Artificial Sequence
  Synthetic
acacactggggcctgtcgtg

SEQ ID NO: 1583 - DNA, 20 bp, Artificial Sequence
  Synthetic
tggctgtaatcccagctact

SEQ ID NO: 1584 - DNA, 20 bp, Artificial Sequence
  Synthetic
caggagaatcacttgaaacc

SEQ ID NO: 1585 - DNA, 20 bp, Artificial Sequence
  Synthetic
tgcctgtcatcccagctact

SEQ ID NO: 1586 - DNA, 20 bp, Artificial Sequence
  Synthetic
cacacactggggcctgtcgt

SEQ ID NO: 1587 - DNA, 20 bp, Artificial Sequence
  Synthetic
caggtggatcacctaaggtc

SEQ ID NO: 1588 - DNA, 20 bp, Artificial Sequence
  Synthetic
tgttgttgttgtttttgaga

SEQ ID NO: 1589 - DNA, 20 bp, Artificial Sequence
  Synthetic
tgcctctaatcccagctact

SEQ ID NO: 1590 - DNA, 20 bp, Artificial Sequence
  Synthetic
ggagtgcagtggagcgatct

SEQ ID NO: 1591 - DNA, 20 bp, Artificial Sequence
  Synthetic
cccagcacttcaggaggcca

SEQ ID NO: 1592 - DNA, 20 bp, Artificial Sequence
  Synthetic
ggctgtaatcccagctactc

SEQ ID NO: 1593 - DNA, 20 bp, Artificial Sequence
  Synthetic
tgcttgagcccaggaggtcg

SEQ ID NO: 1594 - DNA, 20 bp, Artificial Sequence
  Synthetic
tttgtatttttgtagagacg

SEQ ID NO: 1595 - DNA, 20 bp, Artificial Sequence
  Synthetic
ggagtcttactctgttgccc

SEQ ID NO: 1596 - DNA, 20 bp, Artificial Sequence
  Synthetic
ccttggcctcctgaagtgct

SEQ ID NO: 1597 - DNA, 20 bp, Artificial Sequence
  Synthetic
caggagctcaagaccagcct

SEQ ID NO: 1598 - DNA, 20 bp, Artificial Sequence
  Synthetic
ccaggctggtcttgagctcc

SEQ ID NO: 1599 - DNA, 20 bp, Artificial Sequence
  Synthetic
ccaggagctcaagaccagcc

SEQ ID NO: 1600 - DNA, 20 bp, Artificial Sequence
  Synthetic
gaatttcactcttgttgccc

SEQ ID NO: 1601 - DNA, 20 bp, Artificial Sequence
  Synthetic
cgatagtttgctcagaatga

SEQ ID NO: 1602 - DNA, 20 bp, Artificial Sequence
  Synthetic
cccagcactttgggaggaca

SEQ ID NO: 1603 - DNA, 20 bp, Artificial Sequence
  Synthetic
attctgagcaaactatcgca

SEQ ID NO: 1604 - DNA, 20 bp, Artificial Sequence
  Synthetic
ctaaagatacaaaaattagc

SEQ ID NO: 1605 - DNA, 20 bp, Artificial Sequence
  Synthetic
ccttgtcctcccaaagtgct

SEQ ID NO: 1606 - DNA, 20 bp, Artificial Sequence
  Synthetic
cgctccactgcactccagcc

SEQ ID NO: 1607 - DNA, 20 bp, Artificial Sequence
  Synthetic
gcgccattgtactccagcct

SEQ ID NO: 1608 - DNA, 20 bp, Artificial Sequence
  Synthetic
atctcaaaaaaaaaaaaaaa

SEQ ID NO: 1609 - DNA, 20 bp, Artificial Sequence
  Synthetic
gagcggggagggatagcatt

SEQ ID NO: 1610 - DNA, 20 bp, Artificial Sequence
  Synthetic
tcaagcgattctcctgcctc

SEQ ID NO: 1611 - DNA, 20 bp, Artificial Sequence
  Synthetic
ttaatccagtctatcactga

SEQ ID NO: 1612 - DNA, 20 bp, Artificial Sequence
  Synthetic
gagaatcgcttgaacccgga

SEQ ID NO: 1613 - DNA, 20 bp, Artificial Sequence
  Synthetic
gcctctaatcccagctactc

SEQ ID NO: 1614 - DNA, 20 bp, Artificial Sequence
  Synthetic
ttgtaattttagtagagacg

SEQ ID NO: 1615 - DNA, 20 bp, Artificial Sequence
  Synthetic
aatcgcttgaacccgggaga

SEQ ID NO: 1616 - DNA, 20 bp, Artificial Sequence
  Synthetic
ttttgctatgttggccaggc

SEQ ID NO: 1617 - DNA, 20 bp, Artificial Sequence
  Synthetic
taaaaatacaaacattagcc

SEQ ID NO: 1618 - DNA, 20 bp, Artificial Sequence
  Synthetic
tcacacactggggcctgtcg

SEQ ID NO: 1619 - DNA, 20 bp, Artificial Sequence
  Synthetic
ccatgttggtcaggctggtc

SEQ ID NO: 1620 - DNA, 20 bp, Artificial Sequence
  Synthetic
ccagaccagcctgaccaaca

SEQ ID NO: 1621 - DNA, 20 bp, Artificial Sequence
  Synthetic
tgactgtaatcccagcactt

SEQ ID NO: 1622 - DNA, 20 bp, Artificial Sequence
  Synthetic
caggctggtctcaaattcct

SEQ ID NO: 1623 - DNA, 20 bp, Artificial Sequence
  Synthetic
tgggaggatcccttgagccc

SEQ ID NO: 1624 - DNA, 20 bp, Artificial Sequence
  Synthetic
tgcaccactgcactccagtc

SEQ ID NO: 1625 - DNA, 20 bp, Artificial Sequence
  Synthetic
tcttactctgtcgcccaggc

SEQ ID NO: 1626 - DNA, 20 bp, Artificial Sequence
  Synthetic
tctcactctgttgcccagac

SEQ ID NO: 1627 - DNA, 20 bp, Artificial Sequence
  Synthetic
aactgcttgaacccaggagg

SEQ ID NO: 1628 - DNA, 20 bp, Artificial Sequence
  Synthetic
acacaaaaattagctgggca

SEQ ID NO: 1629 - DNA, 20 bp, Artificial Sequence
  Synthetic
ggattacaggcgtgagccac

SEQ ID NO: 1630 - DNA, 20 bp, Artificial Sequence
  Synthetic
gccgaggtgggcggatcatg

SEQ ID NO: 1631 - DNA, 20 bp, Artificial Sequence
  Synthetic
cagaagtttgagaccagcct

SEQ ID NO: 1632 - DNA, 20 bp, Artificial Sequence
  Synthetic
gaggtctcactatgttgccc

SEQ ID NO: 1633 - DNA, 20 bp, Artificial Sequence
  Synthetic
ttttgtatttttgtagagac

SEQ ID NO: 1634 - DNA, 20 bp, Artificial Sequence
  Synthetic
tcgggagttcgagaccagcc

SEQ ID NO: 1635 - DNA, 20 bp, Artificial Sequence
  Synthetic
tgcctgtaaccccagcactt

SEQ ID NO: 1636 - DNA, 20 bp, Artificial Sequence
  Synthetic
tttgtaattttagtagagac

SEQ ID NO: 1637 - DNA, 20 bp, Artificial Sequence
  Synthetic
gctccactgcactccagcct

SEQ ID NO: 1638 - DNA, 20 bp, Artificial Sequence
  Synthetic
gcaggcagatcacctgaggt

SEQ ID NO: 1639 - DNA, 20 bp, Artificial Sequence
  Synthetic
tcctgagtaactgggattac

SEQ ID NO: 1640 - DNA, 20 bp, Artificial Sequence
  Synthetic
cttggcctcccaaagtgctg

SEQ ID NO: 1641 - DNA, 20 bp, Artificial Sequence
  Synthetic
caggtgtgtgccaccacacc

SEQ ID NO: 1642 - DNA, 20 bp, Artificial Sequence
  Synthetic
ccaggctggtctcaaattcc

SEQ ID NO: 1643 - DNA, 20 bp, Artificial Sequence
  Synthetic
ccaggaatttgagaccagcc

SEQ ID NO: 1644 - DNA, 20 bp, Artificial Sequence
  Synthetic
tttttgtatttttgtagaga

SEQ ID NO: 1645 - DNA, 20 bp, Artificial Sequence
  Synthetic
tgtaatcccagcacttcagg

SEQ ID NO: 1646 - DNA, 20 bp, Artificial Sequence
  Synthetic
gagaactgcttgaacccagg

SEQ ID NO: 1647 - DNA, 20 bp, Artificial Sequence
  Synthetic
caggaatttgagaccagcct

SEQ ID NO: 1648 - DNA, 20 bp, Artificial Sequence
  Synthetic
tcagaagtttgagaccagcc

SEQ ID NO: 1649 - DNA, 20 bp, Artificial Sequence
  Synthetic
gactgtaatcccagcacttt

SEQ ID NO: 1650 - DNA, 20 bp, Artificial Sequence
  Synthetic
gcaccactgcactccagtct

SEQ ID NO: 1651 - DNA, 20 bp, Artificial Sequence
  Synthetic
taaaaattagccaggtgtgg

SEQ ID NO: 1652 - DNA, 20 bp, Artificial Sequence
  Synthetic
ttttgtaattttagtagaga

SEQ ID NO: 1653 - DNA, 20 bp, Artificial Sequence
  Synthetic
taaaaatacaaaaatcagct

SEQ ID NO: 1654 - DNA, 20 bp, Artificial Sequence
  Synthetic
gcctcggtctcccaaagtgc

SEQ ID NO: 1655 - DNA, 20 bp, Artificial Sequence
  Synthetic
gcactttgggagaccgaggc

SEQ ID NO: 1656 - DNA, 20 bp, Artificial Sequence
  Synthetic
agcactttgggagaccgagg

SEQ ID NO: 1657 - DNA, 20 bp, Artificial Sequence
  Synthetic
acctcatgatccgcccacct

SEQ ID NO: 1658 - DNA, 20 bp, Artificial Sequence
  Synthetic
cactgcaacctctgccttcc

SEQ ID NO: 1659 - DNA, 20 bp, Artificial Sequence
  Synthetic
tcttactctgttgcccaggc

SEQ ID NO: 1660 - DNA, 20 bp, Artificial Sequence
  Synthetic
cactgcagcctcgacctcct

SEQ ID NO: 1661 - DNA, 20 bp, Artificial Sequence
  Synthetic
aaaaaaaaaaaaaaaaagcc

SEQ ID NO: 1662 - DNA, 20 bp, Artificial Sequence
  Synthetic
ggggtttctccatgttggcc

SEQ ID NO: 1663 - DNA, 20 bp, Artificial Sequence
  Synthetic
caggagaactgcttgaaccc

SEQ ID NO: 1664 - DNA, 20 bp, Artificial Sequence
  Synthetic
ggtgggcggatcatgaggtc

SEQ ID NO: 1665 - DNA, 20 bp, Artificial Sequence
  Synthetic
ttgcccaggctggagtacaa

SEQ ID NO: 1666 - DNA, 20 bp, Artificial Sequence
  Synthetic
tcactgcagcctcgacctcc

SEQ ID NO: 1667 - DNA, 20 bp, Artificial Sequence
  Synthetic
tcactgcaacctctgccttc

SEQ ID NO: 1668 - DNA, 20 bp, Artificial Sequence
  Synthetic
gggattacaggcgtgagcca

SEQ ID NO: 1669 - DNA, 20 bp, Artificial Sequence
  Synthetic
gcctgtagtcccagctacta

SEQ ID NO: 1670 - DNA, 20 bp, Artificial Sequence
  Synthetic
ctaaaaatacaaaaatcagc

SEQ ID NO: 1671 - DNA, 20 bp, Artificial Sequence
  Synthetic
caggcgcccgccaccacacc

SEQ ID NO: 1672 - DNA, 20 bp, Artificial Sequence
  Synthetic
cccagcactttgggagaccg

SEQ ID NO: 1673 - DNA, 20 bp, Artificial Sequence
  Synthetic
ttgcccagactggagtgcag

SEQ ID NO: 1674 - DNA, 20 bp, Artificial Sequence
  Synthetic
caaaaaaaaaaaaaaaaaaa

SEQ ID NO: 1675 - DNA, 20 bp, Artificial Sequence
  Synthetic
acactttgggaggctgaggt

SEQ ID NO: 1676 - DNA, 20 bp, Artificial Sequence
  Synthetic
cctcggtctcccaaagtgct

SEQ ID NO: 1677 - DNA, 20 bp, Artificial Sequence
  Synthetic
tcactgcagccttgaactcc

SEQ ID NO: 1678 - DNA, 20 bp, Artificial Sequence
  Synthetic
aaaaaaaaaaaaaaaaaaga

SEQ ID NO: 1679 - DNA, 20 bp, Artificial Sequence
  Synthetic
gcctgtaaccccagcacttt

SEQ ID NO: 1680 - DNA, 20 bp, Artificial Sequence
  Synthetic
attattatactttaagttct

SEQ ID NO: 1681 - DNA, 20 bp, Artificial Sequence
  Synthetic
ttgtatttttagtagagact

SEQ ID NO: 1682 - DNA, 20 bp, Artificial Sequence
  Synthetic
tcgcccaggctggagtacag

SEQ ID NO: 1683 - DNA, 20 bp, Artificial Sequence
  Synthetic
cgaggcaggcagatcacctg

SEQ ID NO: 1684 - DNA, 20 bp, Artificial Sequence
  Synthetic
cgaggcaggcagatcacctg

SEQ ID NO: 1685 - DNA, 20 bp, Artificial Sequence
  Synthetic
tccctagtagctgggactac

SEQ ID NO: 1686 - DNA, 20 bp, Artificial Sequence
  Synthetic
tttctccatgttggccaggc

SEQ ID NO: 1687 - DNA, 20 bp, Artificial Sequence
  Synthetic
aatacaaaattagccaggca

SEQ ID NO: 1688 - DNA, 20 bp, Artificial Sequence
  Synthetic
tgtagtcccagctactaggg

SEQ ID NO: 1689 - DNA, 20 bp, Artificial Sequence
  Synthetic
ggagtgcaatggcgcaatct

SEQ ID NO: 1690 - DNA, 20 bp, Artificial Sequence
  Synthetic
acaaaattagccaggcatgg

SEQ ID NO: 1691 - DNA, 20 bp, Artificial Sequence
  Synthetic
aatggtgtgaacccgggagg

SEQ ID NO: 1692 - DNA, 20 bp, Artificial Sequence
  Synthetic
ttctcctgcctcagcctccc

SEQ ID NO: 1693 - DNA, 20 bp, Artificial Sequence
  Synthetic
tcaggagttccagaccagcc

SEQ ID NO: 1694 - DNA, 20 bp, Artificial Sequence
  Synthetic
tcccaaagtgctggggttac

SEQ ID NO: 1695 - DNA, 20 bp, Artificial Sequence
  Synthetic
tgtaaccccagcactttggg

SEQ ID NO: 1696 - DNA, 20 bp, Artificial Sequence
  Synthetic
aaaaaaaaaaaaaaaaaaag

SEQ ID NO: 1697 - DNA, 20 bp, Artificial Sequence
  Synthetic
tacaaaaaattagccgggtg

SEQ ID NO: 1698 - DNA, 20 bp, Artificial Sequence
  Synthetic
caggtgtgagccaccacacc

SEQ ID NO: 1699 - DNA, 20 bp, Artificial Sequence
  Synthetic
aacactttgggaggctgagg

SEQ ID NO: 1700 - DNA, 20 bp, Artificial Sequence
  Synthetic
ggtctcgaactcccgacctc

SEQ ID NO: 1701 - DNA, 20 bp, Artificial Sequence
  Synthetic
tacaaaaaattagccaggtg

SEQ ID NO: 1702 - DNA, 20 bp, Artificial Sequence
  Synthetic
caggcatgagccaccgcacc

SEQ ID NO: 1703 - DNA, 20 bp, Artificial Sequence
  Synthetic
tgcgccattgcactccagcc

SEQ ID NO: 1704 - DNA, 20 bp, Artificial Sequence
  Synthetic
ttattatactttaagttcta

SEQ ID NO: 1705 - DNA, 20 bp, Artificial Sequence
  Synthetic
gagaatggtgtgaacccggg

SEQ ID NO: 1706 - DNA, 20 bp, Artificial Sequence
  Synthetic
aattagccgggtgtggtggc

SEQ ID NO: 1707 - DNA, 20 bp, Artificial Sequence
  Synthetic
caccgcatgttctcactcat

SEQ ID NO: 1708 - DNA, 20 bp, Artificial Sequence
  Synthetic
caaggcaggtggatcacctg

SEQ ID NO: 1709 - DNA, 20 bp, Artificial Sequence
  Synthetic
cgcatgttctcactcatagg

SEQ ID NO: 1710 - DNA, 20 bp, Artificial Sequence
  Synthetic
aaattagccgggtgtggtgg

SEQ ID NO: 1711 - DNA, 20 bp, Artificial Sequence
  Synthetic
cgcctgtaatctcagcactt

SEQ ID NO: 1712 - DNA, 20 bp, Artificial Sequence
  Synthetic
ctcaggtgatctgcctgcct

SEQ ID NO: 1713 - DNA, 20 bp, Artificial Sequence
  Synthetic
ctcaggtgatctgcctgcct

SEQ ID NO: 1714 - DNA, 20 bp, Artificial Sequence
  Synthetic
gctactagggaggctgaggc

SEQ ID NO: 1715 - DNA, 20 bp, Artificial Sequence
  Synthetic
tgcttgaacccaggaggcgg

SEQ ID NO: 1716 - DNA, 20 bp, Artificial Sequence
  Synthetic
gcctcagcctccctagtagc

SEQ ID NO: 1717 - DNA, 20 bp, Artificial Sequence
  Synthetic
gagacggggtttctccatgt

SEQ ID NO: 1718 - DNA, 20 bp, Artificial Sequence
  Synthetic
gagtgagaacatgcggtgtt

SEQ ID NO: 1719 - DNA, 20 bp, Artificial Sequence
  Synthetic
ggtacatgtgcacaacgtgc

SEQ ID NO: 1720 - DNA, 20 bp, Artificial Sequence
  Synthetic
aaaaaattagccgggtgtgg

SEQ ID NO: 1721 - DNA, 20 bp, Artificial Sequence
  Synthetic
cctagcactttgggaggccg

SEQ ID NO: 1722 - DNA, 20 bp, Artificial Sequence
  Synthetic
caggcgtgagccactgtgcc

SEQ ID NO: 1723 - DNA, 20 bp, Artificial Sequence
  Synthetic
cccagctactagggaggctg

SEQ ID NO: 1724 - DNA, 20 bp, Artificial Sequence
  Synthetic
cccagctactagggaggctg

SEQ ID NO: 1725 - DNA, 20 bp, Artificial Sequence
  Synthetic
cgcctgtaatcctagcactt

SEQ ID NO: 1726 - DNA, 20 bp, Artificial Sequence
  Synthetic
tgtagggacatggatgaagc

SEQ ID NO: 1727 - DNA, 20 bp, Artificial Sequence
  Synthetic
cctcagcctccctagtagct

SEQ ID NO: 1728 - DNA, 20 bp, Artificial Sequence
  Synthetic
cctcagcctccctagtagct

SEQ ID NO: 1729 - DNA, 20 bp, Artificial Sequence
  Synthetic
tgcctgtaatcctagcactt

SEQ ID NO: 1730 - DNA, 20 bp, Artificial Sequence
  Synthetic
caggcagatcacctgaggtc

SEQ ID NO: 1731 - DNA, 20 bp, Artificial Sequence
  Synthetic
caggcagatcacctgaggtc

SEQ ID NO: 1732 - DNA, 20 bp, Artificial Sequence
  Synthetic
gcatgttctcactcataggt

SEQ ID NO: 1733 - DNA, 20 bp, Artificial Sequence
  Synthetic
cacctatgagtgagaacatg

SEQ ID NO: 1734 - DNA, 20 bp, Artificial Sequence
  Synthetic
gcaggagaatggtgtgaacc

SEQ ID NO: 1735 - DNA, 20 bp, Artificial Sequence
  Synthetic
caggcatgagccaccatgcc

SEQ ID NO: 1736 - DNA, 20 bp, Artificial Sequence
  Synthetic
caggagaatggtgtgaaccc

SEQ ID NO: 1737 - DNA, 20 bp, Artificial Sequence
  Synthetic
catgccattgcactccagcc

SEQ ID NO: 1738 - DNA, 20 bp, Artificial Sequence
  Synthetic
tctcactatgttgcccaggc

SEQ ID NO: 1739 - DNA, 20 bp, Artificial Sequence
  Synthetic
atgccattgcactccagcct

SEQ ID NO: 1740 - DNA, 20 bp, Artificial Sequence
  Synthetic
aaaaaattagccaggtgtgg

SEQ ID NO: 1741 - DNA, 20 bp, Artificial Sequence
  Synthetic
tatgtatacatgtgccatgt

SEQ ID NO: 1742 - DNA, 20 bp, Artificial Sequence
  Synthetic
ggggtttcactgtgttagcc

SEQ ID NO: 1743 - DNA, 20 bp, Artificial Sequence
  Synthetic
gagtttcactcttgttgccc

SEQ ID NO: 1744 - DNA, 20 bp, Artificial Sequence
  Synthetic
ctcaggtgatccacctgcct

SEQ ID NO: 1745 - DNA, 20 bp, Artificial Sequence
  Synthetic
ttcactcttgttgcccaggc

SEQ ID NO: 1746 - DNA, 20 bp, Artificial Sequence
  Synthetic
ttcactcttgttgcccaggc

SEQ ID NO: 1747 - DNA, 20 bp, Artificial Sequence
  Synthetic
gcctgtaatctcagcacttt

SEQ ID NO: 1748 - DNA, 20 bp, Artificial Sequence
  Synthetic
gcgccattgcactccagcct

SEQ ID NO: 1749 - DNA, 20 bp, Artificial Sequence
  Synthetic
ggggtttcaccatgttggtc

SEQ ID NO: 1750 - DNA, 20 bp, Artificial Sequence
  Synthetic
acctcagcctcctgagtagc

SEQ ID NO: 1751 - DNA, 20 bp, Artificial Sequence
  Synthetic
agctactcaggaggctgagg

SEQ ID NO: 1752 - DNA, 20 bp, Artificial Sequence
  Synthetic
agctactcaggaggctgagg

SEQ ID NO: 1753 - DNA, 20 bp, Artificial Sequence
  Synthetic
gctactcaggaggctgaggt

SEQ ID NO: 1754 - DNA, 20 bp, Artificial Sequence
  Synthetic
tttttttttttttttgagac

SEQ ID NO: 1755 - DNA, 20 bp, Artificial Sequence
  Synthetic
tttttttttttttttgagac

SEQ ID NO: 1756 - DNA, 20 bp, Artificial Sequence
  Synthetic
ttttttttttttttgagaca

SEQ ID NO: 1757 - DNA, 20 bp, Artificial Sequence
  Synthetic
ttttttttttttttgagaca

SEQ ID NO: 1758 - DNA, 20 bp, Artificial Sequence
  Synthetic
tttcactgtgttagccagga

SEQ ID NO: 1759 - DNA, 20 bp, Artificial Sequence
  Synthetic
tcacccaggctggagtgcaa

SEQ ID NO: 1760 - DNA, 20 bp, Artificial Sequence
  Synthetic
acctgtaatcccagctactt

SEQ ID NO: 1761 - DNA, 20 bp, Artificial Sequence
  Synthetic
ctaaaaatacaaaattagcc

SEQ ID NO: 1762 - DNA, 20 bp, Artificial Sequence
  Synthetic
gcctgtaatcctagcacttt

SEQ ID NO: 1763 - DNA, 20 bp, Artificial Sequence
  Synthetic
gcctgtaatcctagcacttt

SEQ ID NO: 1764 - DNA, 20 bp, Artificial Sequence
  Synthetic
ggagtgcagtggcgtgatct

SEQ ID NO: 1765 - DNA, 20 bp, Artificial Sequence
  Synthetic
ggagtgcagtggcgtgatct

SEQ ID NO: 1766 - DNA, 20 bp, Artificial Sequence
  Synthetic
tcccaaagtgctgagattac

SEQ ID NO: 1767 - DNA, 20 bp, Artificial Sequence
  Synthetic
tgtaatctcagcactttggg

SEQ ID NO: 1768 - DNA, 20 bp, Artificial Sequence
  Synthetic
tagactggattaagaaaatg

SEQ ID NO: 1769 - DNA, 20 bp, Artificial Sequence
  Synthetic
tttcaccatgttggtcaggc

SEQ ID NO: 1770 - DNA, 20 bp, Artificial Sequence
  Synthetic
cactgcaacctccgcctcct

SEQ ID NO: 1771 - DNA, 20 bp, Artificial Sequence
  Synthetic
ggagtctcgctctgtcgccc

SEQ ID NO: 1772 - DNA, 20 bp, Artificial Sequence
  Synthetic
aatgtggcacatatacacca

SEQ ID NO: 1773 - DNA, 20 bp, Artificial Sequence
  Synthetic
acgccactgcactccagcct

SEQ ID NO: 1774 - DNA, 20 bp, Artificial Sequence
  Synthetic
tcccaaagtgctaggattac

SEQ ID NO: 1775 - DNA, 20 bp, Artificial Sequence
  Synthetic
tcccaaagtgctaggattac

SEQ ID NO: 1776 - DNA, 20 bp, Artificial Sequence
  Synthetic
ggagtgcagtggcgcgatct

SEQ ID NO: 1777 - DNA, 20 bp, Artificial Sequence
  Synthetic
cacgccactgcactccagcc

SEQ ID NO: 1778 - DNA, 20 bp, Artificial Sequence
  Synthetic
tgtaatcctagcactttggg

SEQ ID NO: 1779 - DNA, 20 bp, Artificial Sequence
  Synthetic
caaaaattagctgggcatgg

SEQ ID NO: 1780 - DNA, 20 bp, Artificial Sequence
  Synthetic
ctttgggaggctgaggtggg

SEQ ID NO: 1781 - DNA, 20 bp, Artificial Sequence
  Synthetic
ggtctcaaactcctgacctc

SEQ ID NO: 1782 - DNA, 20 bp, Artificial Sequence
  Synthetic
gagaatcgcttgaacccagg

SEQ ID NO: 1783 - DNA, 20 bp, Artificial Sequence
  Synthetic
caggcgtgagccaccgcgcc

SEQ ID NO: 1784 - DNA, 20 bp, Artificial Sequence
  Synthetic
ctttgggaggccaaggcagg

SEQ ID NO: 1785 - DNA, 20 bp, Artificial Sequence
  Synthetic
ggtcttgaactcctgacctc

SEQ ID NO: 1786 - DNA, 20 bp, Artificial Sequence
  Synthetic
tctcgctctgtcgcccaggc

SEQ ID NO: 1787 - DNA, 20 bp, Artificial Sequence
  Synthetic
ctttgggaggccgaggtggg

SEQ ID NO: 1788 - DNA, 20 bp, Artificial Sequence
  Synthetic
cacctgtaatcccagctact

SEQ ID NO: 1789 - DNA, 20 bp, Artificial Sequence
  Synthetic
cgcgccactgcactccagcc

SEQ ID NO: 1790 - DNA, 20 bp, Artificial Sequence
  Synthetic
acctgtagtcccagctactc

SEQ ID NO: 1791 - DNA, 20 bp, Artificial Sequence
  Synthetic
agggtttcaccatgttggcc

SEQ ID NO: 1792 - DNA, 20 bp, Artificial Sequence
  Synthetic
cactgcaagctccgcctccc

SEQ ID NO: 1793 - DNA, 20 bp, Artificial Sequence
  Synthetic
tgcctgtagtcccagctact

SEQ ID NO: 1794 - DNA, 20 bp, Artificial Sequence
  Synthetic
ggtctcgaactcctgacctc

SEQ ID NO: 1795 - DNA, 20 bp, Artificial Sequence
  Synthetic
tcactgcaagctccgcctcc

SEQ ID NO: 1796 - DNA, 20 bp, Artificial Sequence
  Synthetic
cactgcaacctccgcctccc

SEQ ID NO: 1797 - DNA, 20 bp, Artificial Sequence
  Synthetic
gcactttgggaggccgaggt

SEQ ID NO: 1798 - DNA, 20 bp, Artificial Sequence
  Synthetic
tcactgcaacctccgcctcc

SEQ ID NO: 1799 - DNA, 20 bp, Artificial Sequence
  Synthetic
caagaccagcctggccaaca

SEQ ID NO: 1800 - DNA, 20 bp, Artificial Sequence
  Synthetic
gagatggggtttcaccatgt

SEQ ID NO: 1801 - DNA, 20 bp, Artificial Sequence
  Synthetic
tgtagtcccagctactcagg

SEQ ID NO: 1802 - DNA, 20 bp, Artificial Sequence
  Synthetic
tgtagtcccagctactcagg

SEQ ID NO: 1803 - DNA, 20 bp, Artificial Sequence
  Synthetic
tcctgagtagctgggactac

SEQ ID NO: 1804 - DNA, 20 bp, Artificial Sequence
  Synthetic
tcctgagtagctgggactac

SEQ ID NO: 1805 - DNA, 20 bp, Artificial Sequence
  Synthetic
caggagaatcgcttgaaccc

SEQ ID NO: 1806 - DNA, 20 bp, Artificial Sequence
  Synthetic
caggagaatcgcttgaaccc

SEQ ID NO: 1807 - DNA, 20 bp, Artificial Sequence
  Synthetic
cgagaccagcctggccaaca

SEQ ID NO: 1808 - DNA, 20 bp, Artificial Sequence
  Synthetic
gcaggagaatcgcttgaacc

SEQ ID NO: 1809 - DNA, 20 bp, Artificial Sequence
  Synthetic
gcaggagaatcgcttgaacc

SEQ ID NO: 1810 - DNA, 20 bp, Artificial Sequence
  Synthetic
tgtaatcccagctactcggg

SEQ ID NO: 1811 - DNA, 20 bp, Artificial Sequence
  Synthetic
taaaaatacaaaaaattagc

SEQ ID NO: 1812 - DNA, 20 bp, Artificial Sequence
  Synthetic
gcgccactgcactccagcct

SEQ ID NO: 1813 - DNA, 20 bp, Artificial Sequence
  Synthetic
tcccaagtagctgggattac

SEQ ID NO: 1814 - DNA, 20 bp, Artificial Sequence
  Synthetic
tgtaatcccagctacttggg

SEQ ID NO: 1815 - DNA, 20 bp, Artificial Sequence
  Synthetic
tcaggagttcaagaccagcc

SEQ ID NO: 1816 - DNA, 20 bp, Artificial Sequence
  Synthetic
tcaggagttcgagaccagcc

SEQ ID NO: 1817 - DNA, 20 bp, Artificial Sequence
  Synthetic
tcaggagttcgagaccagcc

SEQ ID NO: 1818 - DNA, 20 bp, Artificial Sequence
  Synthetic
aaaaatacaaaaaattagcc

SEQ ID NO: 1819 - DNA, 20 bp, Artificial Sequence
  Synthetic
aaaaatacaaaaaattagcc

SEQ ID NO: 1820 - DNA, 20 bp, Artificial Sequence
  Synthetic
tcaggagatcgagaccatcc

SEQ ID NO: 1821 - DNA, 20 bp, Artificial Sequence
  Synthetic
gccttggcctcccaaagtgc

SEQ ID NO: 1822 - DNA, 20 bp, Artificial Sequence
  Synthetic
gccttggcctcccaaagtgc

SEQ ID NO: 1823 - DNA, 20 bp, Artificial Sequence
  Synthetic
gcactttgggaggccaaggc

SEQ ID NO: 1824 - DNA, 20 bp, Artificial Sequence
  Synthetic
gcactttgggaggccaaggc

SEQ ID NO: 1825 - DNA, 20 bp, Artificial Sequence
  Synthetic
gcctcagcctcccaaagtgc

SEQ ID NO: 1826 - DNA, 20 bp, Artificial Sequence
  Synthetic
gcactttgggaggctgaggc

SEQ ID NO: 1827 - DNA, 20 bp, Artificial Sequence
  Synthetic
agcactttgggaggctgagg

SEQ ID NO: 1828 - DNA, 20 bp, Artificial Sequence
  Synthetic
tcgcccaggctggagtgcag

SEQ ID NO: 1829 - DNA, 20 bp, Artificial Sequence
  Synthetic
tcgcccaggctggagtgcag

SEQ ID NO: 1830 - DNA, 20 bp, Artificial Sequence
  Synthetic
ttgtatttttagtagagaca

SEQ ID NO: 1831 - DNA, 20 bp, Artificial Sequence
  Synthetic
ttgtatttttagtagagaca

SEQ ID NO: 1832 - DNA, 20 bp, Artificial Sequence
  Synthetic
ttgcccaggctggagtgcag

SEQ ID NO: 1833 - DNA, 20 bp, Artificial Sequence
  Synthetic
cacctgtaatcccagcactt

SEQ ID NO: 1834 - DNA, 20 bp, Artificial Sequence
  Synthetic
gcctgtagtcccagctactc

SEQ ID NO: 1835 - DNA, 20 bp, Artificial Sequence
  Synthetic
acctgtaatcccagcacttt

SEQ ID NO: 1836 - DNA, 20 bp, Artificial Sequence
  Synthetic
gctacttgggaggctgaggc

SEQ ID NO: 1837 - DNA, 20 bp, Artificial Sequence
  Synthetic
gctactcaggaggctgaggc

SEQ ID NO: 1838 - DNA, 20 bp, Artificial Sequence
  Synthetic
cccagcactttgggaggcca

SEQ ID NO: 1839 - DNA, 20 bp, Artificial Sequence
  Synthetic
cccagcactttgggaggcca

SEQ ID NO: 1840 - DNA, 20 bp, Artificial Sequence
  Synthetic
gcctcagcctcccaagtagc

SEQ ID NO: 1841 - DNA, 20 bp, Artificial Sequence
  Synthetic
gcctcggcctcccaaagtgc

SEQ ID NO: 1842 - DNA, 20 bp, Artificial Sequence
  Synthetic
gcctcggcctcccaaagtgc

SEQ ID NO: 1843 - DNA, 20 bp, Artificial Sequence
  Synthetic
ttgtatttttagtagagatg

SEQ ID NO: 1844 - DNA, 20 bp, Artificial Sequence
  Synthetic
ttttttttttttttttgaga

SEQ ID NO: 1845 - DNA, 20 bp, Artificial Sequence
  Synthetic
ttttttttttttttttgaga

SEQ ID NO: 1846 - DNA, 20 bp, Artificial Sequence
  Synthetic
ccttggcctcccaaagtgct

SEQ ID NO: 1847 - DNA, 20 bp, Artificial Sequence
  Synthetic
ccttggcctcccaaagtgct

SEQ ID NO: 1848 - DNA, 20 bp, Artificial Sequence
  Synthetic
cccagcactttgggaggctg

SEQ ID NO: 1849 - DNA, 20 bp, Artificial Sequence
  Synthetic
gcactttgggaggccgaggc

SEQ ID NO: 1850 - DNA, 20 bp, Artificial Sequence
  Synthetic
gcactttgggaggccgaggc

SEQ ID NO: 1851 - DNA, 20 bp, Artificial Sequence
  Synthetic
gcctcagcctcctgagtagc

SEQ ID NO: 1852 - DNA, 20 bp, Artificial Sequence
  Synthetic
tttgtatttttagtagagat

SEQ ID NO: 1853 - DNA, 20 bp, Artificial Sequence
  Synthetic
tttcaccatgttggccaggc

SEQ ID NO: 1854 - DNA, 20 bp, Artificial Sequence
  Synthetic
gctactcgggaggctgaggc

SEQ ID NO: 1855 - DNA, 20 bp, Artificial Sequence
  Synthetic
agcactttgggaggccgagg

SEQ ID NO: 1856 - DNA, 20 bp, Artificial Sequence
  Synthetic
cccagctacttgggaggctg

SEQ ID NO: 1857 - DNA, 20 bp, Artificial Sequence
  Synthetic
tgcctgtaatcccagcactt

SEQ ID NO: 1858 - DNA, 20 bp, Artificial Sequence
  Synthetic
cctcagcctcccaaagtgct

SEQ ID NO: 1859 - DNA, 20 bp, Artificial Sequence
  Synthetic
cctcagcctcccaagtagct

SEQ ID NO: 1860 - DNA, 20 bp, Artificial Sequence
  Synthetic
cccagctactcaggaggctg

SEQ ID NO: 1861 - DNA, 20 bp, Artificial Sequence
  Synthetic
cccagctactcaggaggctg

SEQ ID NO: 1862 - DNA, 20 bp, Artificial Sequence
  Synthetic
gcctcagcctcccgagtagc

SEQ ID NO: 1863 - DNA, 20 bp, Artificial Sequence
  Synthetic
cctcagcctcctgagtagct

SEQ ID NO: 1864 - DNA, 20 bp, Artificial Sequence
  Synthetic
cctcagcctcctgagtagct

SEQ ID NO: 1865 - DNA, 20 bp, Artificial Sequence
  Synthetic
cccagctactcgggaggctg

SEQ ID NO: 1866 - DNA, 20 bp, Artificial Sequence
  Synthetic
ttgtatttttagtagagacg

SEQ ID NO: 1867 - DNA, 20 bp, Artificial Sequence
  Synthetic
cctcagcctcccgagtagct

SEQ ID NO: 1868 - DNA, 20 bp, Artificial Sequence
  Synthetic
cccagcactttgggaggccg

SEQ ID NO: 1869 - DNA, 20 bp, Artificial Sequence
  Synthetic
cccagcactttgggaggccg

SEQ ID NO: 1870 - DNA, 20 bp, Artificial Sequence
  Synthetic
cctcggcctcccaaagtgct

SEQ ID NO: 1871 - DNA, 20 bp, Artificial Sequence
  Synthetic
cctcggcctcccaaagtgct

SEQ ID NO: 1872 - DNA, 20 bp, Artificial Sequence
  Synthetic
cctcggcctcccaaagtgct

SEQ ID NO: 1873 - DNA, 20 bp, Artificial Sequence
  Synthetic
cgcctgtaatcccagcactt

SEQ ID NO: 1874 - DNA, 20 bp, Artificial Sequence
  Synthetic
cgcctgtaatcccagcactt

SEQ ID NO: 1875 - DNA, 20 bp, Artificial Sequence
  Synthetic
cgcctgtaatcccagcactt

SEQ ID NO: 1876 - DNA, 20 bp, Artificial Sequence
  Synthetic
tttgtatttttagtagagac

SEQ ID NO: 1877 - DNA, 20 bp, Artificial Sequence
  Synthetic
tttgtatttttagtagagac

SEQ ID NO: 1878 - DNA, 20 bp, Artificial Sequence
  Synthetic
tttgtatttttagtagagac

SEQ ID NO: 1879 - DNA, 20 bp, Artificial Sequence
  Synthetic
tttgtatttttagtagagac

SEQ ID NO: 1880 - DNA, 20 bp, Artificial Sequence
  Synthetic
ttttgtatttttagtagaga

SEQ ID NO: 1881 - DNA, 20 bp, Artificial Sequence
  Synthetic
ttttgtatttttagtagaga

SEQ ID NO: 1882 - DNA, 20 bp, Artificial Sequence
  Synthetic
gcctgtaatcccagcacttt

SEQ ID NO: 1883 - DNA, 20 bp, Artificial Sequence
  Synthetic
gcctgtaatcccagcacttt

SEQ ID NO: 1884 - DNA, 20 bp, Artificial Sequence
  Synthetic
gcctgtaatcccagcacttt

SEQ ID NO: 1885 - DNA, 20 bp, Artificial Sequence
  Synthetic
gcctgtaatcccagcacttt

SEQ ID NO: 1886 - DNA, 20 bp, Artificial Sequence
  Synthetic
tcccaaagtgctgggattac

SEQ ID NO: 1887 - DNA, 20 bp, Artificial Sequence
  Synthetic
tcccaaagtgctgggattac

SEQ ID NO: 1888 - DNA, 20 bp, Artificial Sequence
  Synthetic
tcccaaagtgctgggattac

SEQ ID NO: 1889 - DNA, 20 bp, Artificial Sequence
  Synthetic
tcccaaagtgctgggattac

SEQ ID NO: 1890 - DNA, 20 bp, Artificial Sequence
  Synthetic
tcccaaagtgctgggattac

SEQ ID NO: 1891 - DNA, 20 bp, Artificial Sequence
  Synthetic
tgtaatcccagcactttggg

SEQ ID NO: 1892 - DNA, 20 bp, Artificial Sequence
  Synthetic
tgtaatcccagcactttggg

SEQ ID NO: 1893 - DNA, 20 bp, Artificial Sequence
  Synthetic
tgtaatcccagcactttggg

SEQ ID NO: 1894 - DNA, 20 bp, Artificial Sequence
  Synthetic
tgtaatcccagcactttggg

SEQ ID NO: 1895 - DNA, 20 bp, Artificial Sequence
  Synthetic
tgtaatcccagcactttggg

SEQ ID NO: 1896 - DNA, 20 bp, Artificial Sequence
  Synthetic
acctgagtaataaaaattgt

SEQ ID NO: 1897 - DNA, 20 bp, Artificial Sequence
  Synthetic
tccaacaatttttattactc

SEQ ID NO: 1898 - DNA, 20 bp, Artificial Sequence
  Synthetic
caacatgccaattagttcac

SEQ ID NO: 1899 - DNA, 20 bp, Artificial Sequence
  Synthetic
ttaataacctgtgaactaat

SEQ ID NO: 1900 - DNA, 20 bp, Artificial Sequence
  Synthetic
tcacaggttattaatttaaa

SEQ ID NO: 1901 - DNA, 20 bp, Artificial Sequence
  Synthetic
tttaaaaggtcactgttgtg

SEQ ID NO: 1902 - DNA, 20 bp, Artificial Sequence
  Synthetic
ctttgtcactgtcttgctcc

SEQ ID NO: 1903 - DNA, 20 bp, Artificial Sequence
  Synthetic
ctgtcttgctcctggcttcc

SEQ ID NO: 1904 - DNA, 20 bp, Artificial Sequence
  Synthetic
cctggcttcctggtttcatg

SEQ ID NO: 1905 - DNA, 20 bp, Artificial Sequence
  Synthetic
cctcatgaaaccaggaagcc

SEQ ID NO: 1906 - DNA, 20 bp, Artificial Sequence
  Synthetic
agaaggttcctcatgaaacc

SEQ ID NO: 1907 - DNA, 20 bp, Artificial Sequence
  Synthetic
aatatcatttgaactttaga

SEQ ID NO: 1908 - DNA, 20 bp, Artificial Sequence
  Synthetic
attgaaactcaacagaaaga

SEQ ID NO: 1909 - DNA, 20 bp, Artificial Sequence
  Synthetic
aaactcaacagaaagaagga

SEQ ID NO: 1910 - DNA, 20 bp, Artificial Sequence
  Synthetic
aactcaacagaaagaaggaa

SEQ ID NO: 1911 - DNA, 20 bp, Artificial Sequence
  Synthetic
ttgtttttatagaaactctg

SEQ ID NO: 1912 - DNA, 20 bp, Artificial Sequence
  Synthetic
taatgagaagtcatgtttct

SEQ ID NO: 1913 - DNA, 20 bp, Artificial Sequence
  Synthetic
tcatgtttcttggaaatttt

SEQ ID NO: 1914 - DNA, 20 bp, Artificial Sequence
  Synthetic
tgtttcttggaaattttagg

SEQ ID NO: 1915 - DNA, 20 bp, Artificial Sequence
  Synthetic
tagaatttaatattgtaagc

SEQ ID NO: 1916 - DNA, 20 bp, Artificial Sequence
  Synthetic
tgtaagccggactattactg

SEQ ID NO: 1917 - DNA, 20 bp, Artificial Sequence
  Synthetic
gtaagccggactattactga

SEQ ID NO: 1918 - DNA, 20 bp, Artificial Sequence
  Synthetic
cttaaccctcagtaatagtc

SEQ ID NO: 1919 - DNA, 20 bp, Artificial Sequence
  Synthetic
cggactattactgagggtta

SEQ ID NO: 1920 - DNA, 20 bp, Artificial Sequence
  Synthetic
gaagctattaatagctctgc

SEQ ID NO: 1921 - DNA, 20 bp, Artificial Sequence
  Synthetic
aagctattaatagctctgct

SEQ ID NO: 1922 - DNA, 20 bp, Artificial Sequence
  Synthetic
tgctgggacaagtgtaaatg

SEQ ID NO: 1923 - DNA, 20 bp, Artificial Sequence
  Synthetic
gtgtaaatgaggactgtccc

SEQ ID NO: 1924 - DNA, 20 bp, Artificial Sequence
  Synthetic
aggactgtcccaggcaaatc

SEQ ID NO: 1925 - DNA, 20 bp, Artificial Sequence
  Synthetic
tcccaggcaaatcaggacaa

SEQ ID NO: 1926 - DNA, 20 bp, Artificial Sequence
  Synthetic
cccaggcaaatcaggacaaa

SEQ ID NO: 1927 - DNA, 20 bp, Artificial Sequence
  Synthetic
ccctttgtcctgatttgcct

SEQ ID NO: 1928 - DNA, 20 bp, Artificial Sequence
  Synthetic
accctttgtcctgatttgcc

SEQ ID NO: 1929 - DNA, 20 bp, Artificial Sequence
  Synthetic
gggtcaccctagtttaaata

SEQ ID NO: 1930 - DNA, 20 bp, Artificial Sequence
  Synthetic
gctaatccatatttaaacta

SEQ ID NO: 1931 - DNA, 20 bp, Artificial Sequence
  Synthetic
tgctaatccatatttaaact

SEQ ID NO: 1932 - DNA, 20 bp, Artificial Sequence
  Synthetic
tttaaatatggattagcata

SEQ ID NO: 1933 - DNA, 20 bp, Artificial Sequence
  Synthetic
tattagactgcagtggtgct

SEQ ID NO: 1934 - DNA, 20 bp, Artificial Sequence
  Synthetic
agacttctattagactgcag

SEQ ID NO: 1935 - DNA, 20 bp, Artificial Sequence
  Synthetic
tagggtttattgactttctt

SEQ ID NO: 1936 - DNA, 20 bp, Artificial Sequence
  Synthetic
tggaatatattgagtcttta

SEQ ID NO: 1937 - DNA, 20 bp, Artificial Sequence
  Synthetic
atggaatatattgagtcttt

SEQ ID NO: 1938 - DNA, 20 bp, Artificial Sequence
  Synthetic
atttagaagtttaaaagtga

SEQ ID NO: 1939 - DNA, 20 bp, Artificial Sequence
  Synthetic
cacttttaaacttctaaatg

SEQ ID NO: 1940 - DNA, 20 bp, Artificial Sequence
  Synthetic
taaacttctaaatgtggccc

SEQ ID NO: 1941 - DNA, 20 bp, Artificial Sequence
  Synthetic
cttctaaatgtggccctggc

SEQ ID NO: 1942 - DNA, 20 bp, Artificial Sequence
  Synthetic
taagcatattatgcctgcca

SEQ ID NO: 1943 - DNA, 20 bp, Artificial Sequence
  Synthetic
ttaagcatattatgcctgcc

SEQ ID NO: 1944 - DNA, 20 bp, Artificial Sequence
  Synthetic
aggcataatatgcttaaata

SEQ ID NO: 1945 - DNA, 20 bp, Artificial Sequence
  Synthetic
agagagtattatgtctaaga

SEQ ID NO: 1946 - DNA, 20 bp, Artificial Sequence
  Synthetic
gggcactagagaggtaagag

SEQ ID NO: 1947 - DNA, 20 bp, Artificial Sequence
  Synthetic
tgaattgatgggcactagag

SEQ ID NO: 1948 - DNA, 20 bp, Artificial Sequence
  Synthetic
aaaaggaattctgaattgat

SEQ ID NO: 1949 - DNA, 20 bp, Artificial Sequence
  Synthetic
taaaaggaattctgaattga

SEQ ID NO: 1950 - DNA, 20 bp, Artificial Sequence
  Synthetic
ttgaaagtataaactttaaa

SEQ ID NO: 1951 - DNA, 20 bp, Artificial Sequence
  Synthetic
tactttcaaatattaaaaat

SEQ ID NO: 1952 - DNA, 20 bp, Artificial Sequence
  Synthetic
aaatattaaaaattggttga

SEQ ID NO: 1953 - DNA, 20 bp, Artificial Sequence
  Synthetic
aatattaaaaattggttgaa

SEQ ID NO: 1954 - DNA, 20 bp, Artificial Sequence
  Synthetic
ttaaaaattggttgaagggt

SEQ ID NO: 1955 - DNA, 20 bp, Artificial Sequence
  Synthetic
taaaaattggttgaagggtt

SEQ ID NO: 1956 - DNA, 20 bp, Artificial Sequence
  Synthetic
aaaaattggttgaagggttg

SEQ ID NO: 1957 - DNA, 20 bp, Artificial Sequence
  Synthetic
tggttgaagggttggggatg

SEQ ID NO: 1958 - DNA, 20 bp, Artificial Sequence
  Synthetic
gggttggggatgtggctcag

SEQ ID NO: 1959 - DNA, 20 bp, Artificial Sequence
  Synthetic
gactcatgaaggctgggcag

SEQ ID NO: 1960 - DNA, 20 bp, Artificial Sequence
  Synthetic
ggactcatgaaggctgggca

SEQ ID NO: 1961 - DNA, 20 bp, Artificial Sequence
  Synthetic
gggactcatgaaggctgggc

SEQ ID NO: 1962 - DNA, 20 bp, Artificial Sequence
  Synthetic
ctcagggactcatgaaggct

SEQ ID NO: 1963 - DNA, 20 bp, Artificial Sequence
  Synthetic
actcagggactcatgaaggc

SEQ ID NO: 1964 - DNA, 20 bp, Artificial Sequence
  Synthetic
tttaactcagggactcatga

SEQ ID NO: 1965 - DNA, 20 bp, Artificial Sequence
  Synthetic
gcttctgggaatttaactca

SEQ ID NO: 1966 - DNA, 20 bp, Artificial Sequence
  Synthetic
tgcttctgggaatttaactc

SEQ ID NO: 1967 - DNA, 20 bp, Artificial Sequence
  Synthetic
gtttgtcttatactgcttct

SEQ ID NO: 1968 - DNA, 20 bp, Artificial Sequence
  Synthetic
tgtttgtcttatactgcttc

SEQ ID NO: 1969 - DNA, 20 bp, Artificial Sequence
  Synthetic
accttacttcatccattttc

SEQ ID NO: 1970 - DNA, 20 bp, Artificial Sequence
  Synthetic
gccagaaaatggatgaagta

SEQ ID NO: 1971 - DNA, 20 bp, Artificial Sequence
  Synthetic
tgtgtagctatgccagaaaa

SEQ ID NO: 1972 - DNA, 20 bp, Artificial Sequence
  Synthetic
catacctgcaatcctagttc

SEQ ID NO: 1973 - DNA, 20 bp, Artificial Sequence
  Synthetic
ttgtccagaactaggattgc

SEQ ID NO: 1974 - DNA, 20 bp, Artificial Sequence
  Synthetic
gcttgaatttgtccagaact

SEQ ID NO: 1975 - DNA, 20 bp, Artificial Sequence
  Synthetic
agttctggacaaattcaagc

SEQ ID NO: 1976 - DNA, 20 bp, Artificial Sequence
  Synthetic
aatgccaacctcagctactt

SEQ ID NO: 1977 - DNA, 20 bp, Artificial Sequence
  Synthetic
caaacctaagtagctgaggt

SEQ ID NO: 1978 - DNA, 20 bp, Artificial Sequence
  Synthetic
caacctcagctacttaggtt

SEQ ID NO: 1979 - DNA, 20 bp, Artificial Sequence
  Synthetic
aacctcagctacttaggttt

SEQ ID NO: 1980 - DNA, 20 bp, Artificial Sequence
  Synthetic
agcccaaacctaagtagctg

SEQ ID NO: 1981 - DNA, 20 bp, Artificial Sequence
  Synthetic
ctgagaccctgtcttaacat

SEQ ID NO: 1982 - DNA, 20 bp, Artificial Sequence
  Synthetic
tgagaccctgtcttaacatt

SEQ ID NO: 1983 - DNA, 20 bp, Artificial Sequence
  Synthetic
gagaccctgtcttaacattg

SEQ ID NO: 1984 - DNA, 20 bp, Artificial Sequence
  Synthetic
agaccctgtcttaacattgg

SEQ ID NO: 1985 - DNA, 20 bp, Artificial Sequence
  Synthetic
tctcccccaatgttaagaca

SEQ ID NO: 1986 - DNA, 20 bp, Artificial Sequence
  Synthetic
ctctcccccaatgttaagac

SEQ ID NO: 1987 - DNA, 20 bp, Artificial Sequence
  Synthetic
ttaacattgggggagagcct

SEQ ID NO: 1988 - DNA, 20 bp, Artificial Sequence
  Synthetic
attgggggagagcctaggct

SEQ ID NO: 1989 - DNA, 20 bp, Artificial Sequence
  Synthetic
tgtatagctcagcctagcct

SEQ ID NO: 1990 - DNA, 20 bp, Artificial Sequence
  Synthetic
ctatacagtaagcctctgtc

SEQ ID NO: 1991 - DNA, 20 bp, Artificial Sequence
  Synthetic
tatacagtaagcctctgtct

SEQ ID NO: 1992 - DNA, 20 bp, Artificial Sequence
  Synthetic
cagtaagcctctgtctggga

SEQ ID NO: 1993 - DNA, 20 bp, Artificial Sequence
  Synthetic
taagcctctgtctgggaagg

SEQ ID NO: 1994 - DNA, 20 bp, Artificial Sequence
  Synthetic
aagcctctgtctgggaagga

SEQ ID NO: 1995 - DNA, 20 bp, Artificial Sequence
  Synthetic
tttccctccttcccagacag

SEQ ID NO: 1996 - DNA, 20 bp, Artificial Sequence
  Synthetic
tgtctgggaaggagggaaaa

SEQ ID NO: 1997 - DNA, 20 bp, Artificial Sequence
  Synthetic
tgggaaggagggaaaaagga

SEQ ID NO: 1998 - DNA, 20 bp, Artificial Sequence
  Synthetic
gaaaaaggaaggaaagacat

SEQ ID NO: 1999 - DNA, 20 bp, Artificial Sequence
  Synthetic
gacattggttgaatgacttg

SEQ ID NO: 2000 - DNA, 20 bp, Artificial Sequence
  Synthetic
acattggttgaatgacttgt

SEQ ID NO: 2001 - DNA, 20 bp, Artificial Sequence
  Synthetic
actgtatgtttagagtgttc

SEQ ID NO: 2002 - DNA, 20 bp, Artificial Sequence
  Synthetic
ctgtatgtttagagtgttca

SEQ ID NO: 2003 - DNA, 20 bp, Artificial Sequence
  Synthetic
gtttagagtgttcagggaaa

SEQ ID NO: 2004 - DNA, 20 bp, Artificial Sequence
  Synthetic
tagagtgttcagggaaaagg

SEQ ID NO: 2005 - DNA, 20 bp, Artificial Sequence
  Synthetic
aggtcatttgcagagcagag

SEQ ID NO: 2006 - DNA, 20 bp, Artificial Sequence
  Synthetic
attcgtcttatctgagtggc

SEQ ID NO: 2007 - DNA, 20 bp, Artificial Sequence
  Synthetic
gtgtattcgtcttatctgag

SEQ ID NO: 2008 - DNA, 20 bp, Artificial Sequence
  Synthetic
catgaatatagaagaaacag

SEQ ID NO: 2009 - DNA, 20 bp, Artificial Sequence
  Synthetic
aataaaagacacaagactgc

SEQ ID NO: 2010 - DNA, 20 bp, Artificial Sequence
  Synthetic
ctaataatatttctagtgtc

SEQ ID NO: 2011 - DNA, 20 bp, Artificial Sequence
  Synthetic
cttgagattttattttcaca

SEQ ID NO: 2012 - DNA, 20 bp, Artificial Sequence
  Synthetic
cttgtgaaaataaaatctca

SEQ ID NO: 2013 - DNA, 20 bp, Artificial Sequence
  Synthetic
aataaaatctcaaggtcata

SEQ ID NO: 2014 - DNA, 20 bp, Artificial Sequence
  Synthetic
tacggcaaacacaaagaaac

SEQ ID NO: 2015 - DNA, 20 bp, Artificial Sequence
  Synthetic
gtcttcagacactccagaag

SEQ ID NO: 2016 - DNA, 20 bp, Artificial Sequence
  Synthetic
tcttcagacactccagaaga

SEQ ID NO: 2017 - DNA, 20 bp, Artificial Sequence
  Synthetic
cgagatctgatgccctcttc

SEQ ID NO: 2018 - DNA, 20 bp, Artificial Sequence
  Synthetic
gagggcatcagatctcgtta

SEQ ID NO: 2019 - DNA, 20 bp, Artificial Sequence
  Synthetic
gcatcagatctcgttacgga

SEQ ID NO: 2020 - DNA, 20 bp, Artificial Sequence
  Synthetic
gatggttgtgagccaccatg

SEQ ID NO: 2021 - DNA, 20 bp, Artificial Sequence
  Synthetic
gtgagccaccatgtggttgc

SEQ ID NO: 2022 - DNA, 20 bp, Artificial Sequence
  Synthetic
tgagccaccatgtggttgct

SEQ ID NO: 2023 - DNA, 20 bp, Artificial Sequence
  Synthetic
aaatcccagcaaccacatgg

SEQ ID NO: 2024 - DNA, 20 bp, Artificial Sequence
  Synthetic
ttcaaatcccagcaaccaca

SEQ ID NO: 2025 - DNA, 20 bp, Artificial Sequence
  Synthetic
ggatttgaacttcagacctt

SEQ ID NO: 2026 - DNA, 20 bp, Artificial Sequence
  Synthetic
cagaccttcggaagagcagt

SEQ ID NO: 2027 - DNA, 20 bp, Artificial Sequence
  Synthetic
agaccttcggaagagcagtc

SEQ ID NO: 2028 - DNA, 20 bp, Artificial Sequence
  Synthetic
gcacccgactgctcttccga

SEQ ID NO: 2029 - DNA, 20 bp, Artificial Sequence
  Synthetic
ggctggtgagatggctcagt

SEQ ID NO: 2030 - DNA, 20 bp, Artificial Sequence
  Synthetic
gggctggtgagatggctcag

SEQ ID NO: 2031 - DNA, 20 bp, Artificial Sequence
  Synthetic
tgagccatctcaccagcccc

SEQ ID NO: 2032 - DNA, 20 bp, Artificial Sequence
  Synthetic
aaaacctggggctggtgaga

SEQ ID NO: 2033 - DNA, 20 bp, Artificial Sequence
  Synthetic
agaaaaaaaaaacctggggc

SEQ ID NO: 2034 - DNA, 20 bp, Artificial Sequence
  Synthetic
actaagaaaaaaaaaacctg

SEQ ID NO: 2035 - DNA, 20 bp, Artificial Sequence
  Synthetic
aactaagaaaaaaaaaacct

SEQ ID NO: 2036 - DNA, 20 bp, Artificial Sequence
  Synthetic
caactaagaaaaaaaaaacc

SEQ ID NO: 2037 - DNA, 20 bp, Artificial Sequence
  Synthetic
tattgttattcttttgagac

SEQ ID NO: 2038 - DNA, 20 bp, Artificial Sequence
  Synthetic
aggatcccacactgaaactc

SEQ ID NO: 2039 - DNA, 20 bp, Artificial Sequence
  Synthetic
gctagcctgagtttcagtgt

SEQ ID NO: 2040 - DNA, 20 bp, Artificial Sequence
  Synthetic
ggctagcctgagtttcagtg

SEQ ID NO: 2041 - DNA, 20 bp, Artificial Sequence
  Synthetic
ggctagccttcaatttccta

SEQ ID NO: 2042 - DNA, 20 bp, Artificial Sequence
  Synthetic
tcaaatccataggaaattga

SEQ ID NO: 2043 - DNA, 20 bp, Artificial Sequence
  Synthetic
tgctatgaggtcaaatccat

SEQ ID NO: 2044 - DNA, 20 bp, Artificial Sequence
  Synthetic
gaaactggctgactgctatg

SEQ ID NO: 2045 - DNA, 20 bp, Artificial Sequence
  Synthetic
agcactcagaaggtggaaac

SEQ ID NO: 2046 - DNA, 20 bp, Artificial Sequence
  Synthetic
aaatcttagcactcagaagg

SEQ ID NO: 2047 - DNA, 20 bp, Artificial Sequence
  Synthetic
ttgaaatcttagcactcaga

SEQ ID NO: 2048 - DNA, 20 bp, Artificial Sequence
  Synthetic
ggaattgggtgtggtggctc

SEQ ID NO: 2049 - DNA, 20 bp, Artificial Sequence
  Synthetic
atcttaggaattgggtgtgg

SEQ ID NO: 2050 - DNA, 20 bp, Artificial Sequence
  Synthetic
catatcttaggaattgggtg

SEQ ID NO: 2051 - DNA, 20 bp, Artificial Sequence
  Synthetic
aaaaacatatcttaggaatt

SEQ ID NO: 2052 - DNA, 20 bp, Artificial Sequence
  Synthetic
taaaaacatatcttaggaat

SEQ ID NO: 2053 - DNA, 20 bp, Artificial Sequence
  Synthetic
cttgcttaaaaacatatctt

SEQ ID NO: 2054 - DNA, 20 bp, Artificial Sequence
  Synthetic
ctaagatatgtttttaagca

SEQ ID NO: 2055 - DNA, 20 bp, Artificial Sequence
  Synthetic
atgtttttaagcaaggttat

SEQ ID NO: 2056 - DNA, 20 bp, Artificial Sequence
  Synthetic
cacgtcattgcaaagggtta

SEQ ID NO: 2057 - DNA, 20 bp, Artificial Sequence
  Synthetic
accctttgcaatgacgtgtc

SEQ ID NO: 2058 - DNA, 20 bp, Artificial Sequence
  Synthetic
tcctgacacgtcattgcaaa

SEQ ID NO: 2059 - DNA, 20 bp, Artificial Sequence
  Synthetic
ttcctgacacgtcattgcaa

SEQ ID NO: 2060 - DNA, 20 bp, Artificial Sequence
  Synthetic
gacaactggaaaaaaaaaaa

SEQ ID NO: 2061 - DNA, 20 bp, Artificial Sequence
  Synthetic
tttttttttttccagttgtc

SEQ ID NO: 2062 - DNA, 20 bp, Artificial Sequence
  Synthetic
ttttttccagttgtcaggcc

SEQ ID NO: 2063 - DNA, 20 bp, Artificial Sequence
  Synthetic
ccagttgtcaggcctggcaa

SEQ ID NO: 2064 - DNA, 20 bp, Artificial Sequence
  Synthetic
ccattgccaggcctgacaac

SEQ ID NO: 2065 - DNA, 20 bp, Artificial Sequence
  Synthetic
caggcctggcaatggagccc

SEQ ID NO: 2066 - DNA, 20 bp, Artificial Sequence
  Synthetic
aggcctggcaatggagccca

SEQ ID NO: 2067 - DNA, 20 bp, Artificial Sequence
  Synthetic
gggccctgggctccattgcc

SEQ ID NO: 2068 - DNA, 20 bp, Artificial Sequence
  Synthetic
tttagcaagcacagggccct

SEQ ID NO: 2069 - DNA, 20 bp, Artificial Sequence
  Synthetic
gtttagcaagcacagggccc

SEQ ID NO: 2070 - DNA, 20 bp, Artificial Sequence
  Synthetic
gccctgtgcttgctaaacga

SEQ ID NO: 2071 - DNA, 20 bp, Artificial Sequence
  Synthetic
gccatcgtttagcaagcaca

SEQ ID NO: 2072 - DNA, 20 bp, Artificial Sequence
  Synthetic
agccatcgtttagcaagcac

SEQ ID NO: 2073 - DNA, 20 bp, Artificial Sequence
  Synthetic
gctgggtatatataacttag

SEQ ID NO: 2074 - DNA, 20 bp, Artificial Sequence
  Synthetic
agctgggtatatataactta

SEQ ID NO: 2075 - DNA, 20 bp, Artificial Sequence
  Synthetic
aagctgggtatatataactt

SEQ ID NO: 2076 - DNA, 20 bp, Artificial Sequence
  Synthetic
atatatacccagcttatccc

SEQ ID NO: 2077 - DNA, 20 bp, Artificial Sequence
  Synthetic
gaaagatcctgggataagct

SEQ ID NO: 2078 - DNA, 20 bp, Artificial Sequence
  Synthetic
agaaagatcctgggataagc

SEQ ID NO: 2079 - DNA, 20 bp, Artificial Sequence
  Synthetic
gaaagtctgagaaagatcct

SEQ ID NO: 2080 - DNA, 20 bp, Artificial Sequence
  Synthetic
agaaagtctgagaaagatcc

SEQ ID NO: 2081 - DNA, 20 bp, Artificial Sequence
  Synthetic
ctatcgatgttgcttctctt

SEQ ID NO: 2082 - DNA, 20 bp, Artificial Sequence
  Synthetic
ctttttgtgagaaaagagca

SEQ ID NO: 2083 - DNA, 20 bp, Artificial Sequence
  Synthetic
tctaagcaagaacccttgtc

SEQ ID NO: 2084 - DNA, 20 bp, Artificial Sequence
  Synthetic
atctctctgactccagacaa

SEQ ID NO: 2085 - DNA, 20 bp, Artificial Sequence
  Synthetic
tatctctctgactccagaca

SEQ ID NO: 2086 - DNA, 20 bp, Artificial Sequence
  Synthetic
gtcagagagatagcttagtc

SEQ ID NO: 2087 - DNA, 20 bp, Artificial Sequence
  Synthetic
tttaaacaagaaaagttctg

SEQ ID NO: 2088 - DNA, 20 bp, Artificial Sequence
  Synthetic
ttttaaacaagaaaagttct

SEQ ID NO: 2089 - DNA, 20 bp, Artificial Sequence
  Synthetic
tttttaaacaagaaaagttc

SEQ ID NO: 2090 - DNA, 20 bp, Artificial Sequence
  Synthetic
caaacaaacaaacaaaaact

SEQ ID NO: 2091 - DNA, 20 bp, Artificial Sequence
  Synthetic
caaaaactaggcatgacagc

SEQ ID NO: 2092 - DNA, 20 bp, Artificial Sequence
  Synthetic
actaggcatgacagctggag

SEQ ID NO: 2093 - DNA, 20 bp, Artificial Sequence
  Synthetic
aggcatgacagctggagagg

SEQ ID NO: 2094 - DNA, 20 bp, Artificial Sequence
  Synthetic
attaacagcacttgttaaag

SEQ ID NO: 2095 - DNA, 20 bp, Artificial Sequence
  Synthetic
tgttaaagaggacctcagct

SEQ ID NO: 2096 - DNA, 20 bp, Artificial Sequence
  Synthetic
aggacctcagcttggttccc

SEQ ID NO: 2097 - DNA, 20 bp, Artificial Sequence
  Synthetic
ggacctcagcttggttccca

SEQ ID NO: 2098 - DNA, 20 bp, Artificial Sequence
  Synthetic
gagccctgggaaccaagctg

SEQ ID NO: 2099 - DNA, 20 bp, Artificial Sequence
  Synthetic
aactggagttatagagccct

SEQ ID NO: 2100 - DNA, 20 bp, Artificial Sequence
  Synthetic
gaactggagttatagagccc

SEQ ID NO: 2101 - DNA, 20 bp, Artificial Sequence
  Synthetic
ggctctataactccagttcc

SEQ ID NO: 2102 - DNA, 20 bp, Artificial Sequence
  Synthetic
gctctataactccagttcca

SEQ ID NO: 2103 - DNA, 20 bp, Artificial Sequence
  Synthetic
gctgtctgaggccctggaac

SEQ ID NO: 2104 - DNA, 20 bp, Artificial Sequence
  Synthetic
caggaggctgtctgaggccc

SEQ ID NO: 2105 - DNA, 20 bp, Artificial Sequence
  Synthetic
aggctacaggaggctgtctg

SEQ ID NO: 2106 - DNA, 20 bp, Artificial Sequence
  Synthetic
atgcatgaagaggctacagg

SEQ ID NO: 2107 - DNA, 20 bp, Artificial Sequence
  Synthetic
ctgatgcatgaagaggctac

SEQ ID NO: 2108 - DNA, 20 bp, Artificial Sequence
  Synthetic
gcctcttcatgcatcagaca

SEQ ID NO: 2109 - DNA, 20 bp, Artificial Sequence
  Synthetic
accatgtctgatgcatgaag

SEQ ID NO: 2110 - DNA, 20 bp, Artificial Sequence
  Synthetic
gacatggtccatatgcatgc

SEQ ID NO: 2111 - DNA, 20 bp, Artificial Sequence
  Synthetic
gtgtttgacctgcatgcata

SEQ ID NO: 2112 - DNA, 20 bp, Artificial Sequence
  Synthetic
aaaaataaaagtctaaaaaa

SEQ ID NO: 2113 - DNA, 20 bp, Artificial Sequence
  Synthetic
catgctataatcccagtgct

SEQ ID NO: 2114 - DNA, 20 bp, Artificial Sequence
  Synthetic
atgctataatcccagtgcta

SEQ ID NO: 2115 - DNA, 20 bp, Artificial Sequence
  Synthetic
ctataatcccagtgctaggg

SEQ ID NO: 2116 - DNA, 20 bp, Artificial Sequence
  Synthetic
acatttgcctccctagcact

SEQ ID NO: 2117 - DNA, 20 bp, Artificial Sequence
  Synthetic
gacatttgcctccctagcac

SEQ ID NO: 2118 - DNA, 20 bp, Artificial Sequence
  Synthetic
gtgctagggaggcaaatgtc

SEQ ID NO: 2119 - DNA, 20 bp, Artificial Sequence
  Synthetic
ggcaaatgtctggaccttgt

SEQ ID NO: 2120 - DNA, 20 bp, Artificial Sequence
  Synthetic
aatgtctggaccttgtcggt

SEQ ID NO: 2121 - DNA, 20 bp, Artificial Sequence
  Synthetic
gactgactggccgaccgaca

SEQ ID NO: 2122 - DNA, 20 bp, Artificial Sequence
  Synthetic
tgactggctggctgactgac

SEQ ID NO: 2123 - DNA, 20 bp, Artificial Sequence
  Synthetic
gctaggctagactgactggc

SEQ ID NO: 2124 - DNA, 20 bp, Artificial Sequence
  Synthetic
ctatgctaggctagactgac

SEQ ID NO: 2125 - DNA, 20 bp, Artificial Sequence
  Synthetic
ctagcctagcatagcctact

SEQ ID NO: 2126 - DNA, 20 bp, Artificial Sequence
  Synthetic
cacacctagtaggctatgct

SEQ ID NO: 2127 - DNA, 20 bp, Artificial Sequence
  Synthetic
tgggctggagcacacctagt

SEQ ID NO: 2128 - DNA, 20 bp, Artificial Sequence
  Synthetic
gacaaggtctctcattgggc

SEQ ID NO: 2129 - DNA, 20 bp, Artificial Sequence
  Synthetic
tagagacaaggtctctcatt

SEQ ID NO: 2130 - DNA, 20 bp, Artificial Sequence
  Synthetic
ttagagacaaggtctctcat

SEQ ID NO: 2131 - DNA, 20 bp, Artificial Sequence
  Synthetic
agaccttgtctctaaaaaaa

SEQ ID NO: 2132 - DNA, 20 bp, Artificial Sequence
  Synthetic
gaccttgtctctaaaaaaaa

SEQ ID NO: 2133 - DNA, 20 bp, Artificial Sequence
  Synthetic
tacccttttttttagagaca

SEQ ID NO: 2134 - DNA, 20 bp, Artificial Sequence
  Synthetic
ggtagaaagaaaagacaaaa

SEQ ID NO: 2135 - DNA, 20 bp, Artificial Sequence
  Synthetic
gacaaaatggatgtctcctg

SEQ ID NO: 2136 - DNA, 20 bp, Artificial Sequence
  Synthetic
ctcctgaggaatgataccca

SEQ ID NO: 2137 - DNA, 20 bp, Artificial Sequence
  Synthetic
atccgtgggtatcattcctc

SEQ ID NO: 2138 - DNA, 20 bp, Artificial Sequence
  Synthetic
ggacaattgtgggtatccgt

SEQ ID NO: 2139 - DNA, 20 bp, Artificial Sequence
  Synthetic
aggacaattgtgggtatccg

SEQ ID NO: 2140 - DNA, 20 bp, Artificial Sequence
  Synthetic
ggatacccacaattgtcctc

SEQ ID NO: 2141 - DNA, 20 bp, Artificial Sequence
  Synthetic
ggagaccagaggacaattgt

SEQ ID NO: 2142 - DNA, 20 bp, Artificial Sequence
  Synthetic
cggagaccagaggacaattg

SEQ ID NO: 2143 - DNA, 20 bp, Artificial Sequence
  Synthetic
gtattgcacacggagaccag

SEQ ID NO: 2144 - DNA, 20 bp, Artificial Sequence
  Synthetic
acatgggtttgtattgcaca

SEQ ID NO: 2145 - DNA, 20 bp, Artificial Sequence
  Synthetic
tgttgcaaatattcagacat

SEQ ID NO: 2146 - DNA, 20 bp, Artificial Sequence
  Synthetic
ctgttgcaaatattcagaca

SEQ ID NO: 2147 - DNA, 20 bp, Artificial Sequence
  Synthetic
catgtctgaatatttgcaac

SEQ ID NO: 2148 - DNA, 20 bp, Artificial Sequence
  Synthetic
atgtctgaatatttgcaaca

SEQ ID NO: 2149 - DNA, 20 bp, Artificial Sequence
  Synthetic
agcacagctttactagatga

SEQ ID NO: 2150 - DNA, 20 bp, Artificial Sequence
  Synthetic
aagcacagctttactagatg

SEQ ID NO: 2151 - DNA, 20 bp, Artificial Sequence
  Synthetic
catctagtaaagctgtgctt

SEQ ID NO: 2152 - DNA, 20 bp, Artificial Sequence
  Synthetic
gaaaaataagacagatggga

SEQ ID NO: 2153 - DNA, 20 bp, Artificial Sequence
  Synthetic
agaaaaataagacagatggg

SEQ ID NO: 2154 - DNA, 20 bp, Artificial Sequence
  Synthetic
agtagaaaaataagacagat

SEQ ID NO: 2155 - DNA, 20 bp, Artificial Sequence
  Synthetic
cagtagaaaaataagacaga

SEQ ID NO: 2156 - DNA, 20 bp, Artificial Sequence
  Synthetic
catctgtcttatttttctac

SEQ ID NO: 2157 - DNA, 20 bp, Artificial Sequence
  Synthetic
atttttctactggtgtgcta

SEQ ID NO: 2158 - DNA, 20 bp, Artificial Sequence
  Synthetic
gtgctaaggcaccatgacca

SEQ ID NO: 2159 - DNA, 20 bp, Artificial Sequence
  Synthetic
tctctaagttgccttggtca

SEQ ID NO: 2160 - DNA, 20 bp, Artificial Sequence
  Synthetic
tcttcttctctaagttgcct

SEQ ID NO: 2161 - DNA, 20 bp, Artificial Sequence
  Synthetic
gaagaagaaacagtttattg

SEQ ID NO: 2162 - DNA, 20 bp, Artificial Sequence
  Synthetic
aagaagaaacagtttattga

SEQ ID NO: 2163 - DNA, 20 bp, Artificial Sequence
  Synthetic
ttgagggtttatagttatag

SEQ ID NO: 2164 - DNA, 20 bp, Artificial Sequence
  Synthetic
tgagggtttatagttataga

SEQ ID NO: 2165 - DNA, 20 bp, Artificial Sequence
  Synthetic
gtttatagttatagagggta

SEQ ID NO: 2166 - DNA, 20 bp, Artificial Sequence
  Synthetic
tagttatagagggtaaggca

SEQ ID NO: 2167 - DNA, 20 bp, Artificial Sequence
  Synthetic
tagagggtaaggcaaggact

SEQ ID NO: 2168 - DNA, 20 bp, Artificial Sequence
  Synthetic
taaggcaaggacttggtagc

SEQ ID NO: 2169 - DNA, 20 bp, Artificial Sequence
  Synthetic
gcaaggacttggtagcaggc

SEQ ID NO: 2170 - DNA, 20 bp, Artificial Sequence
  Synthetic
ggacttggtagcaggcaggc

SEQ ID NO: 2171 - DNA, 20 bp, Artificial Sequence
  Synthetic
ttggtagcaggcaggcaggc

SEQ ID NO: 2172 - DNA, 20 bp, Artificial Sequence
  Synthetic
agcaggcaggcaggcaggca

SEQ ID NO: 2173 - DNA, 20 bp, Artificial Sequence
  Synthetic
caggcaggcaggcatggtac

SEQ ID NO: 2174 - DNA, 20 bp, Artificial Sequence
  Synthetic
catggtactggtgtagtagc

SEQ ID NO: 2175 - DNA, 20 bp, Artificial Sequence
  Synthetic
atggtactggtgtagtagct

SEQ ID NO: 2176 - DNA, 20 bp, Artificial Sequence
  Synthetic
ggagcttgtatcttgagaca

SEQ ID NO: 2177 - DNA, 20 bp, Artificial Sequence
  Synthetic
aaagctgagagatagctaag

SEQ ID NO: 2178 - DNA, 20 bp, Artificial Sequence
  Synthetic
aagctgagagatagctaagt

SEQ ID NO: 2179 - DNA, 20 bp, Artificial Sequence
  Synthetic
gagagatagctaagtgggcc

SEQ ID NO: 2180 - DNA, 20 bp, Artificial Sequence
  Synthetic
aggtttcaaaagctcacacc

SEQ ID NO: 2181 - DNA, 20 bp, Artificial Sequence
  Synthetic
tttcactggggacagctttg

SEQ ID NO: 2182 - DNA, 20 bp, Artificial Sequence
  Synthetic
ttgatggaggcatttcactg

SEQ ID NO: 2183 - DNA, 20 bp, Artificial Sequence
  Synthetic
gttgatggaggcatttcact

SEQ ID NO: 2184 - DNA, 20 bp, Artificial Sequence
  Synthetic
tgttgatggaggcatttcac

SEQ ID NO: 2185 - DNA, 20 bp, Artificial Sequence
  Synthetic
gtgaaatgcctccatcaaca

SEQ ID NO: 2186 - DNA, 20 bp, Artificial Sequence
  Synthetic
aggtgtggccttgttgatgg

SEQ ID NO: 2187 - DNA, 20 bp, Artificial Sequence
  Synthetic
gttaggtgtggccttgttga

SEQ ID NO: 2188 - DNA, 20 bp, Artificial Sequence
  Synthetic
tgtttgggaagggttaggtg

SEQ ID NO: 2189 - DNA, 20 bp, Artificial Sequence
  Synthetic
agaactgtttgggaagggtt

SEQ ID NO: 2190 - DNA, 20 bp, Artificial Sequence
  Synthetic
ttggtagaactgtttgggaa

SEQ ID NO: 2191 - DNA, 20 bp, Artificial Sequence
  Synthetic
gttggtagaactgtttggga

SEQ ID NO: 2192 - DNA, 20 bp, Artificial Sequence
  Synthetic
tcccaaacagttctaccaac

SEQ ID NO: 2193 - DNA, 20 bp, Artificial Sequence
  Synthetic
cccaaacagttctaccaact

SEQ ID NO: 2194 - DNA, 20 bp, Artificial Sequence
  Synthetic
cccagttggtagaactgttt

SEQ ID NO: 2195 - DNA, 20 bp, Artificial Sequence
  Synthetic
tcccagttggtagaactgtt

SEQ ID NO: 2196 - DNA, 20 bp, Artificial Sequence
  Synthetic
atgaatgcttggttcccagt

SEQ ID NO: 2197 - DNA, 20 bp, Artificial Sequence
  Synthetic
ctgaggctcatatgaatgct

SEQ ID NO: 2198 - DNA, 20 bp, Artificial Sequence
  Synthetic
caagcattcatatgagcctc

SEQ ID NO: 2199 - DNA, 20 bp, Artificial Sequence
  Synthetic
aagcattcatatgagcctca

SEQ ID NO: 2200 - DNA, 20 bp, Artificial Sequence
  Synthetic
agcattcatatgagcctcag

SEQ ID NO: 2201 - DNA, 20 bp, Artificial Sequence
  Synthetic
tgaatgagactgctcccctg

SEQ ID NO: 2202 - DNA, 20 bp, Artificial Sequence
  Synthetic
gtactcagtacactgcccca

SEQ ID NO: 2203 - DNA, 20 bp, Artificial Sequence
  Synthetic
tactcagtacactgccccat

SEQ ID NO: 2204 - DNA, 20 bp, Artificial Sequence
  Synthetic
ttagaggacttctgcccatg

SEQ ID NO: 2205 - DNA, 20 bp, Artificial Sequence
  Synthetic
tttagaggacttctgcccat

SEQ ID NO: 2206 - DNA, 20 bp, Artificial Sequence
  Synthetic
gtttagaggacttctgccca

SEQ ID NO: 2207 - DNA, 20 bp, Artificial Sequence
  Synthetic
atgggcagaagtcctctaaa

SEQ ID NO: 2208 - DNA, 20 bp, Artificial Sequence
  Synthetic
acacattagtaaccgtttag

SEQ ID NO: 2209 - DNA, 20 bp, Artificial Sequence
  Synthetic
tatccctcaccatacttaga

SEQ ID NO: 2210 - DNA, 20 bp, Artificial Sequence
  Synthetic
tttccttctaagtatggtga

SEQ ID NO: 2211 - DNA, 20 bp, Artificial Sequence
  Synthetic
gtttccttctaagtatggtg

SEQ ID NO: 2212 - DNA, 20 bp, Artificial Sequence
  Synthetic
ggcttgtttccttctaagta

SEQ ID NO: 2213 - DNA, 20 bp, Artificial Sequence
  Synthetic
ggaaacaagccatcccaaaa

SEQ ID NO: 2214 - DNA, 20 bp, Artificial Sequence
  Synthetic
tcatgctatccattttggga

SEQ ID NO: 2215 - DNA, 20 bp, Artificial Sequence
  Synthetic
tgagtcatgctatccatttt

SEQ ID NO: 2216 - DNA, 20 bp, Artificial Sequence
  Synthetic
ctgagtcatgctatccattt

SEQ ID NO: 2217 - DNA, 20 bp, Artificial Sequence
  Synthetic
ttgctctgggtgaagtacac

SEQ ID NO: 2218 - DNA, 20 bp, Artificial Sequence
  Synthetic
tacttcacccagagcaaatg

SEQ ID NO: 2219 - DNA, 20 bp, Artificial Sequence
  Synthetic
acccagagcaaatgtggata

SEQ ID NO: 2220 - DNA, 20 bp, Artificial Sequence
  Synthetic
accgtatccacatttgctct

SEQ ID NO: 2221 - DNA, 20 bp, Artificial Sequence
  Synthetic
caccgtatccacatttgctc

SEQ ID NO: 2222 - DNA, 20 bp, Artificial Sequence
  Synthetic
cagagcaaatgtggatacgg

SEQ ID NO: 2223 - DNA, 20 bp, Artificial Sequence
  Synthetic
agagcaaatgtggatacggt

SEQ ID NO: 2224 - DNA, 20 bp, Artificial Sequence
  Synthetic
gtggatacggtgggaaacag

SEQ ID NO: 2225 - DNA, 20 bp, Artificial Sequence
  Synthetic
gggaaacagaggacagtgat

SEQ ID NO: 2226 - DNA, 20 bp, Artificial Sequence
  Synthetic
aggacagtgataggacacaa

SEQ ID NO: 2227 - DNA, 20 bp, Artificial Sequence
  Synthetic
gtctcagtttctagttcaga

SEQ ID NO: 2228 - DNA, 20 bp, Artificial Sequence
  Synthetic
agacataaaccaacacacat

SEQ ID NO: 2229 - DNA, 20 bp, Artificial Sequence
  Synthetic
tgtatctttcctatgtgtgt

SEQ ID NO: 2230 - DNA, 20 bp, Artificial Sequence
  Synthetic
ataggaaagatacactccac

SEQ ID NO: 2231 - DNA, 20 bp, Artificial Sequence
  Synthetic
agatacactccactggacag

SEQ ID NO: 2232 - DNA, 20 bp, Artificial Sequence
  Synthetic
gatacactccactggacagt

SEQ ID NO: 2233 - DNA, 20 bp, Artificial Sequence
  Synthetic
catgggctcccactgtccag

SEQ ID NO: 2234 - DNA, 20 bp, Artificial Sequence
  Synthetic
cagtgggagcccatgcacaa

SEQ ID NO: 2235 - DNA, 20 bp, Artificial Sequence
  Synthetic
gcccatgcacaaaggttctt

SEQ ID NO: 2236 - DNA, 20 bp, Artificial Sequence
  Synthetic
gccaaagaacctttgtgcat

SEQ ID NO: 2237 - DNA, 20 bp, Artificial Sequence
  Synthetic
agccaaagaacctttgtgca

SEQ ID NO: 2238 - DNA, 20 bp, Artificial Sequence
  Synthetic
tgacagcagtttcttattat

SEQ ID NO: 2239 - DNA, 20 bp, Artificial Sequence
  Synthetic
gacagcagtttcttattatt

SEQ ID NO: 2240 - DNA, 20 bp, Artificial Sequence
  Synthetic
gatgagctttgtttctgccc

SEQ ID NO: 2241 - DNA, 20 bp, Artificial Sequence
  Synthetic
atgagctttgtttctgccct

SEQ ID NO: 2242 - DNA, 20 bp, Artificial Sequence
  Synthetic
ccctgggtgagagtttattt

SEQ ID NO: 2243 - DNA, 20 bp, Artificial Sequence
  Synthetic
cctaaataaactctcaccca

SEQ ID NO: 2244 - DNA, 20 bp, Artificial Sequence
  Synthetic
tcctaaataaactctcaccc

SEQ ID NO: 2245 - DNA, 20 bp, Artificial Sequence
  Synthetic
cacactaagacaaccactga

SEQ ID NO: 2246 - DNA, 20 bp, Artificial Sequence
  Synthetic
actttgttctaggccatcag

SEQ ID NO: 2247 - DNA, 20 bp, Artificial Sequence
  Synthetic
cagtgctctgactttgttct

SEQ ID NO: 2248 - DNA, 20 bp, Artificial Sequence
  Synthetic
agtcagagcactgtgcgttg

SEQ ID NO: 2249 - DNA, 20 bp, Artificial Sequence
  Synthetic
cactgtgcgttgtggatctt

SEQ ID NO: 2250 - DNA, 20 bp, Artificial Sequence
  Synthetic
gatgctttaatcatcatgaa

SEQ ID NO: 2251 - DNA, 20 bp, Artificial Sequence
  Synthetic
actaacacattttaatagga

SEQ ID NO: 2252 - DNA, 20 bp, Artificial Sequence
  Synthetic
atggactaacacattttaat

SEQ ID NO: 2253 - DNA, 20 bp, Artificial Sequence
  Synthetic
aaaatgtgttagtccatttt

SEQ ID NO: 2254 - DNA, 20 bp, Artificial Sequence
  Synthetic
aaatgtgttagtccattttt

SEQ ID NO: 2255 - DNA, 20 bp, Artificial Sequence
  Synthetic
aatgtgttagtccatttttg

SEQ ID NO: 2256 - DNA, 20 bp, Artificial Sequence
  Synthetic
agtaaacataaccccaaaaa

SEQ ID NO: 2257 - DNA, 20 bp, Artificial Sequence
  Synthetic
gggttatgtttactatacaa

SEQ ID NO: 2258 - DNA, 20 bp, Artificial Sequence
  Synthetic
ttatgtttactatacaaagg

SEQ ID NO: 2259 - DNA, 20 bp, Artificial Sequence
  Synthetic
gtttactatacaaaggtgga

SEQ ID NO: 2260 - DNA, 20 bp, Artificial Sequence
  Synthetic
tttactatacaaaggtggaa

SEQ ID NO: 2261 - DNA, 20 bp, Artificial Sequence
  Synthetic
ttactatacaaaggtggaag

SEQ ID NO: 2262 - DNA, 20 bp, Artificial Sequence
  Synthetic
caaaggtggaaggggttatc

SEQ ID NO: 2263 - DNA, 20 bp, Artificial Sequence
  Synthetic
gttatctggccccatcttac

SEQ ID NO: 2264 - DNA, 20 bp, Artificial Sequence
  Synthetic
acacagttacctgtaagatg

SEQ ID NO: 2265 - DNA, 20 bp, Artificial Sequence
  Synthetic
gacacagttacctgtaagat

SEQ ID NO: 2266 - DNA, 20 bp, Artificial Sequence
  Synthetic
ggacacagttacctgtaaga

SEQ ID NO: 2267 - DNA, 20 bp, Artificial Sequence
  Synthetic
aggtaactgtgtcccttttg

SEQ ID NO: 2268 - DNA, 20 bp, Artificial Sequence
  Synthetic
tggtttttatatccacaaaa

SEQ ID NO: 2269 - DNA, 20 bp, Artificial Sequence
  Synthetic
atggtttttatatccacaaa

SEQ ID NO: 2270 - DNA, 20 bp, Artificial Sequence
  Synthetic
aataaaattgcagtatctga

SEQ ID NO: 2271 - DNA, 20 bp, Artificial Sequence
  Synthetic
tatttttgattatgtgtctg

SEQ ID NO: 2272 - DNA, 20 bp, Artificial Sequence
  Synthetic
atttttgattatgtgtctga

SEQ ID NO: 2273 - DNA, 20 bp, Artificial Sequence
  Synthetic
cagtatgcacatctgcatgc

SEQ ID NO: 2274 - DNA, 20 bp, Artificial Sequence
  Synthetic
catctgcatgcaggtgcctg

SEQ ID NO: 2275 - DNA, 20 bp, Artificial Sequence
  Synthetic
caggtgcctgtggaagcctg

SEQ ID NO: 2276 - DNA, 20 bp, Artificial Sequence
  Synthetic
atgtctccacaggcttccac

SEQ ID NO: 2277 - DNA, 20 bp, Artificial Sequence
  Synthetic
aggtgatctgatgtctccac

SEQ ID NO: 2278 - DNA, 20 bp, Artificial Sequence
  Synthetic
gacatcagatcacctgaagc

SEQ ID NO: 2279 - DNA, 20 bp, Artificial Sequence
  Synthetic
tcacctgaagctggagtttc

SEQ ID NO: 2280 - DNA, 20 bp, Artificial Sequence
  Synthetic
ctgcctgaaactccagcttc

SEQ ID NO: 2281 - DNA, 20 bp, Artificial Sequence
  Synthetic
agttttatgccaccagacac

SEQ ID NO: 2282 - DNA, 20 bp, Artificial Sequence
  Synthetic
ttctcagcaccagtgtctgg

SEQ ID NO: 2283 - DNA, 20 bp, Artificial Sequence
  Synthetic
ctattctcagcaccagtgtc

SEQ ID NO: 2284 - DNA, 20 bp, Artificial Sequence
  Synthetic
ataaaatatactgcttttgc

SEQ ID NO: 2285 - DNA, 20 bp, Artificial Sequence
  Synthetic
gttgcttttggctggagaga

SEQ ID NO: 2286 - DNA, 20 bp, Artificial Sequence
  Synthetic
ttttaaaggttgcttttggc

SEQ ID NO: 2287 - DNA, 20 bp, Artificial Sequence
  Synthetic
cagcttttaaaggttgcttt

SEQ ID NO: 2288 - DNA, 20 bp, Artificial Sequence
  Synthetic
aaagcaacctttaaaagctg

SEQ ID NO: 2289 - DNA, 20 bp, Artificial Sequence
  Synthetic
acataaaccacagcttttaa

SEQ ID NO: 2290 - DNA, 20 bp, Artificial Sequence
  Synthetic
ctctaagtggatgaattaaa

SEQ ID NO: 2291 - DNA, 20 bp, Artificial Sequence
  Synthetic
catttaattcatccacttag

SEQ ID NO: 2292 - DNA, 20 bp, Artificial Sequence
  Synthetic
atttaattcatccacttaga

SEQ ID NO: 2293 - DNA, 20 bp, Artificial Sequence
  Synthetic
attgaagtgtaccctctaag

SEQ ID NO: 2294 - DNA, 20 bp, Artificial Sequence
  Synthetic
aaaatatgcttacagatctg

SEQ ID NO: 2295 - DNA, 20 bp, Artificial Sequence
  Synthetic
aaatatgcttacagatctgt

SEQ ID NO: 2296 - DNA, 20 bp, Artificial Sequence
  Synthetic
tgctaaaagggttctaaaat

SEQ ID NO: 2297 - DNA, 20 bp, Artificial Sequence
  Synthetic
taatatctgtagtgctaaaa

SEQ ID NO: 2298 - DNA, 20 bp, Artificial Sequence
  Synthetic
ttaatatctgtagtgctaaa

SEQ ID NO: 2299 - DNA, 20 bp, Artificial Sequence
  Synthetic
gctgggggctggggagaata

SEQ ID NO: 2300 - DNA, 20 bp, Artificial Sequence
  Synthetic
agctgggggctggggagaat

SEQ ID NO: 2301 - DNA, 20 bp, Artificial Sequence
  Synthetic
gggactggagctgggggctg

SEQ ID NO: 2302 - DNA, 20 bp, Artificial Sequence
  Synthetic
agggactggagctgggggct

SEQ ID NO: 2303 - DNA, 20 bp, Artificial Sequence
  Synthetic
cagggactggagctgggggc

SEQ ID NO: 2304 - DNA, 20 bp, Artificial Sequence
  Synthetic
cagcccccagctccagtccc

SEQ ID NO: 2305 - DNA, 20 bp, Artificial Sequence
  Synthetic
atgccagggactggagctgg

SEQ ID NO: 2306 - DNA, 20 bp, Artificial Sequence
  Synthetic
gatgccagggactggagctg

SEQ ID NO: 2307 - DNA, 20 bp, Artificial Sequence
  Synthetic
ggatgccagggactggagct

SEQ ID NO: 2308 - DNA, 20 bp, Artificial Sequence
  Synthetic
tggatgccagggactggagc

SEQ ID NO: 2309 - DNA, 20 bp, Artificial Sequence
  Synthetic
gatttgtggatgccagggac

SEQ ID NO: 2310 - DNA, 20 bp, Artificial Sequence
  Synthetic
aaggggatttgtggatgcca

SEQ ID NO: 2311 - DNA, 20 bp, Artificial Sequence
  Synthetic
gaaggggatttgtggatgcc

SEQ ID NO: 2312 - DNA, 20 bp, Artificial Sequence
  Synthetic
gatggcaggaaggggatttg

SEQ ID NO: 2313 - DNA, 20 bp, Artificial Sequence
  Synthetic
aatctatagatggcaggaag

SEQ ID NO: 2314 - DNA, 20 bp, Artificial Sequence
  Synthetic
gaatctatagatggcaggaa

SEQ ID NO: 2315 - DNA, 20 bp, Artificial Sequence
  Synthetic
tgaatctatagatggcagga

SEQ ID NO: 2316 - DNA, 20 bp, Artificial Sequence
  Synthetic
gaggtgaatctatagatggc

SEQ ID NO: 2317 - DNA, 20 bp, Artificial Sequence
  Synthetic
agaagaggtgaatctataga

SEQ ID NO: 2318 - DNA, 20 bp, Artificial Sequence
  Synthetic
ttcagtgtaaagtctagaag

SEQ ID NO: 2319 - DNA, 20 bp, Artificial Sequence
  Synthetic
ttctagactttacactgaaa

SEQ ID NO: 2320 - DNA, 20 bp, Artificial Sequence
  Synthetic
aaatggtattacacaacatg

SEQ ID NO: 2321 - DNA, 20 bp, Artificial Sequence
  Synthetic
ttgcttgccgtgtgtctgtg

SEQ ID NO: 2322 - DNA, 20 bp, Artificial Sequence
  Synthetic
agatgaacctcacagacaca

SEQ ID NO: 2323 - DNA, 20 bp, Artificial Sequence
  Synthetic
tcatctgtgttgagcatgaa

SEQ ID NO: 2324 - DNA, 20 bp, Artificial Sequence
  Synthetic
taggcgacaggcatattcat

SEQ ID NO: 2325 - DNA, 20 bp, Artificial Sequence
  Synthetic
ttaggcgacaggcatattca

SEQ ID NO: 2326 - DNA, 20 bp, Artificial Sequence
  Synthetic
gtgttgctattttaggcgac

SEQ ID NO: 2327 - DNA, 20 bp, Artificial Sequence
  Synthetic
tgtgaaagtgttgctatttt

SEQ ID NO: 2328 - DNA, 20 bp, Artificial Sequence
  Synthetic
ccttctttcttcttcccaag

SEQ ID NO: 2329 - DNA, 20 bp, Artificial Sequence
  Synthetic
cctcttgggaagaagaaaga

SEQ ID NO: 2330 - DNA, 20 bp, Artificial Sequence
  Synthetic
cttctttcttcttcccaaga

SEQ ID NO: 2331 - DNA, 20 bp, Artificial Sequence
  Synthetic
gctgcaataatgtccctctt

SEQ ID NO: 2332 - DNA, 20 bp, Artificial Sequence
  Synthetic
ggctgcaataatgtccctct

SEQ ID NO: 2333 - DNA, 20 bp, Artificial Sequence
  Synthetic
agacacaggagaaaactagc

SEQ ID NO: 2334 - DNA, 20 bp, Artificial Sequence
  Synthetic
agaaacacgaaaaaagacac

SEQ ID NO: 2335 - DNA, 20 bp, Artificial Sequence
  Synthetic
cgtgtttctcaagtagatga

SEQ ID NO: 2336 - DNA, 20 bp, Artificial Sequence
  Synthetic
gtgtttctcaagtagatgaa

SEQ ID NO: 2337 - DNA, 20 bp, Artificial Sequence
  Synthetic
tctcaagtagatgaagggac

SEQ ID NO: 2338 - DNA, 20 bp, Artificial Sequence
  Synthetic
ttaggaaactgacaaagcag

SEQ ID NO: 2339 - DNA, 20 bp, Artificial Sequence
  Synthetic
tttaggaaactgacaaagca

SEQ ID NO: 2340 - DNA, 20 bp, Artificial Sequence
  Synthetic
atttaggaaactgacaaagc

SEQ ID NO: 2341 - DNA, 20 bp, Artificial Sequence
  Synthetic
aatacagtattcactcattt

SEQ ID NO: 2342 - DNA, 20 bp, Artificial Sequence
  Synthetic
aaatgagtgaatactgtatt

SEQ ID NO: 2343 - DNA, 20 bp, Artificial Sequence
  Synthetic
tattttggtctttctgattg

SEQ ID NO: 2344 - DNA, 20 bp, Artificial Sequence
  Synthetic
ttattttggtctttctgatt

SEQ ID NO: 2345 - DNA, 20 bp, Artificial Sequence
  Synthetic
attattttggtctttctgat

SEQ ID NO: 2346 - DNA, 20 bp, Artificial Sequence
  Synthetic
gagattattttaaattattt

SEQ ID NO: 2347 - DNA, 20 bp, Artificial Sequence
  Synthetic
atctcgtctctatatcacta

SEQ ID NO: 2348 - DNA, 20 bp, Artificial Sequence
  Synthetic
ctaaggtatccttttccact

SEQ ID NO: 2349 - DNA, 20 bp, Artificial Sequence
  Synthetic
taaggtatccttttccactt

SEQ ID NO: 2350 - DNA, 20 bp, Artificial Sequence
  Synthetic
ctgcatggcccaagtggaaa

SEQ ID NO: 2351 - DNA, 20 bp, Artificial Sequence
  Synthetic
atttctctgcatggcccaag

SEQ ID NO: 2352 - DNA, 20 bp, Artificial Sequence
  Synthetic
ggcatgcttatttctctgca

SEQ ID NO: 2353 - DNA, 20 bp, Artificial Sequence
  Synthetic
gggtggggtggggtcaatca

SEQ ID NO: 2354 - DNA, 20 bp, Artificial Sequence
  Synthetic
ctgggggttggggtggggtg

SEQ ID NO: 2355 - DNA, 20 bp, Artificial Sequence
  Synthetic
actgggggttggggtggggt

SEQ ID NO: 2356 - DNA, 20 bp, Artificial Sequence
  Synthetic
cactgggggttggggtgggg

SEQ ID NO: 2357 - DNA, 20 bp, Artificial Sequence
  Synthetic
caccccaccccaacccccag

SEQ ID NO: 2358 - DNA, 20 bp, Artificial Sequence
  Synthetic
caccactgggggttggggtg

SEQ ID NO: 2359 - DNA, 20 bp, Artificial Sequence
  Synthetic
tcaccactgggggttggggt

SEQ ID NO: 2360 - DNA, 20 bp, Artificial Sequence
  Synthetic
gtcaccactgggggttgggg

SEQ ID NO: 2361 - DNA, 20 bp, Artificial Sequence
  Synthetic
cttgtcaccactgggggttg

SEQ ID NO: 2362 - DNA, 20 bp, Artificial Sequence
  Synthetic
cccaacccccagtggtgaca

SEQ ID NO: 2363 - DNA, 20 bp, Artificial Sequence
  Synthetic
ccttgtcaccactgggggtt

SEQ ID NO: 2364 - DNA, 20 bp, Artificial Sequence
  Synthetic
tccttgtcaccactgggggt

SEQ ID NO: 2365 - DNA, 20 bp, Artificial Sequence
  Synthetic
gaggtccttgtcaccactgg

SEQ ID NO: 2366 - DNA, 20 bp, Artificial Sequence
  Synthetic
ggaggtccttgtcaccactg

SEQ ID NO: 2367 - DNA, 20 bp, Artificial Sequence
  Synthetic
gggaggtccttgtcaccact

SEQ ID NO: 2368 - DNA, 20 bp, Artificial Sequence
  Synthetic
ggggaggtccttgtcaccac

SEQ ID NO: 2369 - DNA, 20 bp, Artificial Sequence
  Synthetic
ggtgacaaggacctccccag

SEQ ID NO: 2370 - DNA, 20 bp, Artificial Sequence
  Synthetic
aaatggttgagccgctgggg

SEQ ID NO: 2371 - DNA, 20 bp, Artificial Sequence
  Synthetic
ttcaaatggttgagccgctg

SEQ ID NO: 2372 - DNA, 20 bp, Artificial Sequence
  Synthetic
attcaaatggttgagccgct

SEQ ID NO: 2373 - DNA, 20 bp, Artificial Sequence
  Synthetic
tattcaaatggttgagccgc

SEQ ID NO: 2374 - DNA, 20 bp, Artificial Sequence
  Synthetic
gctcaaccatttgaataaaa

SEQ ID NO: 2375 - DNA, 20 bp, Artificial Sequence
  Synthetic
aagtgtcctttttattcaaa

SEQ ID NO: 2376 - DNA, 20 bp, Artificial Sequence
  Synthetic
atcttagatttgtgcaaaat

SEQ ID NO: 2377 - DNA, 20 bp, Artificial Sequence
  Synthetic
catcttagatttgtgcaaaa

SEQ ID NO: 2378 - DNA, 20 bp, Artificial Sequence
  Synthetic
acaaatctaagatgagcaag

SEQ ID NO: 2379 - DNA, 20 bp, Artificial Sequence
  Synthetic
gtcacctgtaaacatgtgcc

SEQ ID NO: 2380 - DNA, 20 bp, Artificial Sequence
  Synthetic
tgctccaggcacatgtttac

SEQ ID NO: 2381 - DNA, 20 bp, Artificial Sequence
  Synthetic
gtaaacatgtgcctggagca

SEQ ID NO: 2382 - DNA, 20 bp, Artificial Sequence
  Synthetic
ctcaggtcgttccgtgctcc

SEQ ID NO: 2383 - DNA, 20 bp, Artificial Sequence
  Synthetic
gagcacggaacgacctgagt

SEQ ID NO: 2384 - DNA, 20 bp, Artificial Sequence
  Synthetic
cgacctgagtaggcagaaaa

SEQ ID NO: 2385 - DNA, 20 bp, Artificial Sequence
  Synthetic
cctgagtaggcagaaaaagg

SEQ ID NO: 2386 - DNA, 20 bp, Artificial Sequence
  Synthetic
ccacctttttctgcctactc

SEQ ID NO: 2387 - DNA, 20 bp, Artificial Sequence
  Synthetic
atttatgatttttcttttaa

SEQ ID NO: 2388 - DNA, 20 bp, Artificial Sequence
  Synthetic
agtgagaaaggtgggggaaa

SEQ ID NO: 2389 - DNA, 20 bp, Artificial Sequence
  Synthetic
ttggaaagtgagaaaggtgg

SEQ ID NO: 2390 - DNA, 20 bp, Artificial Sequence
  Synthetic
gttggaaagtgagaaaggtg

SEQ ID NO: 2391 - DNA, 20 bp, Artificial Sequence
  Synthetic
tgttggaaagtgagaaaggt

SEQ ID NO: 2392 - DNA, 20 bp, Artificial Sequence
  Synthetic
ttgttggaaagtgagaaagg

SEQ ID NO: 2393 - DNA, 20 bp, Artificial Sequence
  Synthetic
atattgttggaaagtgagaa

SEQ ID NO: 2394 - DNA, 20 bp, Artificial Sequence
  Synthetic
tttccaacaatattatattc

SEQ ID NO: 2395 - DNA, 20 bp, Artificial Sequence
  Synthetic
acaccagaatataatattgt

SEQ ID NO: 2396 - DNA, 20 bp, Artificial Sequence
  Synthetic
cttttattccccagttgttt

SEQ ID NO: 2397 - DNA, 20 bp, Artificial Sequence
  Synthetic
tttaatcaccaaaacaactg

SEQ ID NO: 2398 - DNA, 20 bp, Artificial Sequence
  Synthetic
atttaatcaccaaaacaact

SEQ ID NO: 2399 - DNA, 20 bp, Artificial Sequence
  Synthetic
gatttaatcaccaaaacaac

SEQ ID NO: 2400 - DNA, 20 bp, Artificial Sequence
  Synthetic
ttttggtgattaaatcattt

SEQ ID NO: 2401 - DNA, 20 bp, Artificial Sequence
  Synthetic
tttggtgattaaatcatttt

SEQ ID NO: 2402 - DNA, 20 bp, Artificial Sequence
  Synthetic
ttggtgattaaatcattttg

SEQ ID NO: 2403 - DNA, 20 bp, Artificial Sequence
  Synthetic
tggtgattaaatcattttgg

SEQ ID NO: 2404 - DNA, 20 bp, Artificial Sequence
  Synthetic
actctcattcactgctccct

SEQ ID NO: 2405 - DNA, 20 bp, Artificial Sequence
  Synthetic
aaaaaaaacactgtcaccaa

SEQ ID NO: 2406 - DNA, 20 bp, Artificial Sequence
  Synthetic
gaaaaaaaacactgtcacca

SEQ ID NO: 2407 - DNA, 20 bp, Artificial Sequence
  Synthetic
gcagagacagagggaacagc

SEQ ID NO: 2408 - DNA, 20 bp, Artificial Sequence
  Synthetic
tgaaaatgagcagagacaga

SEQ ID NO: 2409 - DNA, 20 bp, Artificial Sequence
  Synthetic
atgaaaatgagcagagacag

SEQ ID NO: 2410 - DNA, 20 bp, Artificial Sequence
  Synthetic
ctgtctctgctcattttcat

SEQ ID NO: 2411 - DNA, 20 bp, Artificial Sequence
  Synthetic
tgctcattttcataggaatc

SEQ ID NO: 2412 - DNA, 20 bp, Artificial Sequence
  Synthetic
atctggcaccttagaatccc

SEQ ID NO: 2413 - DNA, 20 bp, Artificial Sequence
  Synthetic
gcaggcagcctgggattcta

SEQ ID NO: 2414 - DNA, 20 bp, Artificial Sequence
  Synthetic
catttgactgcaggcagcct

SEQ ID NO: 2415 - DNA, 20 bp, Artificial Sequence
  Synthetic
gcatttgactgcaggcagcc

SEQ ID NO: 2416 - DNA, 20 bp, Artificial Sequence
  Synthetic
cctgcagtcaaatgcttgct

SEQ ID NO: 2417 - DNA, 20 bp, Artificial Sequence
  Synthetic
cctagcaagcatttgactgc

SEQ ID NO: 2418 - DNA, 20 bp, Artificial Sequence
  Synthetic
ctgcagtcaaatgcttgcta

SEQ ID NO: 2419 - DNA, 20 bp, Artificial Sequence
  Synthetic
cagtcaaatgcttgctaggg

SEQ ID NO: 2420 - DNA, 20 bp, Artificial Sequence
  Synthetic
agtcaaatgcttgctaggga

SEQ ID NO: 2421 - DNA, 20 bp, Artificial Sequence
  Synthetic
gtcaaatgcttgctagggag

SEQ ID NO: 2422 - DNA, 20 bp, Artificial Sequence
  Synthetic
ttgctagggaggggagccag

SEQ ID NO: 2423 - DNA, 20 bp, Artificial Sequence
  Synthetic
tgctagggaggggagccagt

SEQ ID NO: 2424 - DNA, 20 bp, Artificial Sequence
  Synthetic
tagggaggggagccagtggg

SEQ ID NO: 2425 - DNA, 20 bp, Artificial Sequence
  Synthetic
agggaggggagccagtgggt

SEQ ID NO: 2426 - DNA, 20 bp, Artificial Sequence
  Synthetic
gggaggggagccagtgggtg

SEQ ID NO: 2427 - DNA, 20 bp, Artificial Sequence
  Synthetic
ggaggggagccagtgggtgg

SEQ ID NO: 2428 - DNA, 20 bp, Artificial Sequence
  Synthetic
ttgcaggttcccccacccac

SEQ ID NO: 2429 - DNA, 20 bp, Artificial Sequence
  Synthetic
atttggagttgatttcttgc

SEQ ID NO: 2430 - DNA, 20 bp, Artificial Sequence
  Synthetic
aaatcaactccaaatttaat

SEQ ID NO: 2431 - DNA, 20 bp, Artificial Sequence
  Synthetic
gagcttagtcctattaaatt

SEQ ID NO: 2432 - DNA, 20 bp, Artificial Sequence
  Synthetic
ctgctaatcaggcatggtgt

SEQ ID NO: 2433 - DNA, 20 bp, Artificial Sequence
  Synthetic
accatgcctgattagcagct

SEQ ID NO: 2434 - DNA, 20 bp, Artificial Sequence
  Synthetic
acctagctgctaatcaggca

SEQ ID NO: 2435 - DNA, 20 bp, Artificial Sequence
  Synthetic
atgagacctagctgctaatc

SEQ ID NO: 2436 - DNA, 20 bp, Artificial Sequence
  Synthetic
ggtctcatccttacccctcc

SEQ ID NO: 2437 - DNA, 20 bp, Artificial Sequence
  Synthetic
tccttacccctccaggaata

SEQ ID NO: 2438 - DNA, 20 bp, Artificial Sequence
  Synthetic
tccttattcctggaggggta

SEQ ID NO: 2439 - DNA, 20 bp, Artificial Sequence
  Synthetic
tacccctccaggaataagga

SEQ ID NO: 2440 - DNA, 20 bp, Artificial Sequence
  Synthetic
aaccttccttattcctggag

SEQ ID NO: 2441 - DNA, 20 bp, Artificial Sequence
  Synthetic
caaccttccttattcctgga

SEQ ID NO: 2442 - DNA, 20 bp, Artificial Sequence
  Synthetic
gcaaccttccttattcctgg

SEQ ID NO: 2443 - DNA, 20 bp, Artificial Sequence
  Synthetic
tctgcaaccttccttattcc

SEQ ID NO: 2444 - DNA, 20 bp, Artificial Sequence
  Synthetic
aggttgcagaagtccctgaa

SEQ ID NO: 2445 - DNA, 20 bp, Artificial Sequence
  Synthetic
ggctcagcaaatacctttca

SEQ ID NO: 2446 - DNA, 20 bp, Artificial Sequence
  Synthetic
aggctcagcaaatacctttc

SEQ ID NO: 2447 - DNA, 20 bp, Artificial Sequence
  Synthetic
gctgagcctcttgtgaaccg

SEQ ID NO: 2448 - DNA, 20 bp, Artificial Sequence
  Synthetic
ctgagcctcttgtgaaccgt

SEQ ID NO: 2449 - DNA, 20 bp, Artificial Sequence
  Synthetic
gcctcttgtgaaccgtgggt

SEQ ID NO: 2450 - DNA, 20 bp, Artificial Sequence
  Synthetic
gccaacccacggttcacaag

SEQ ID NO: 2451 - DNA, 20 bp, Artificial Sequence
  Synthetic
agttcaggtgagccaaccca

SEQ ID NO: 2452 - DNA, 20 bp, Artificial Sequence
  Synthetic
aagaatatctactaaagttc

SEQ ID NO: 2453 - DNA, 20 bp, Artificial Sequence
  Synthetic
atattctttagcgacatatt

SEQ ID NO: 2454 - DNA, 20 bp, Artificial Sequence
  Synthetic
tattctttagcgacatattt

SEQ ID NO: 2455 - DNA, 20 bp, Artificial Sequence
  Synthetic
ttagcgacatatttgggctt

SEQ ID NO: 2456 - DNA, 20 bp, Artificial Sequence
  Synthetic
tgtggagagataaaagagag

SEQ ID NO: 2457 - DNA, 20 bp, Artificial Sequence
  Synthetic
ttatctctccacaaaagtct

SEQ ID NO: 2458 - DNA, 20 bp, Artificial Sequence
  Synthetic
tcagtttgccaagacttttg

SEQ ID NO: 2459 - DNA, 20 bp, Artificial Sequence
  Synthetic
tgatgtttatgcaaccagta

SEQ ID NO: 2460 - DNA, 20 bp, Artificial Sequence
  Synthetic
tatgcaaccagtaaggcctc

SEQ ID NO: 2461 - DNA, 20 bp, Artificial Sequence
  Synthetic
atgcaaccagtaaggcctct

SEQ ID NO: 2462 - DNA, 20 bp, Artificial Sequence
  Synthetic
tgcaaccagtaaggcctctg

SEQ ID NO: 2463 - DNA, 20 bp, Artificial Sequence
  Synthetic
ctcagccccagaggccttac

SEQ ID NO: 2464 - DNA, 20 bp, Artificial Sequence
  Synthetic
cagtaaggcctctggggctg

SEQ ID NO: 2465 - DNA, 20 bp, Artificial Sequence
  Synthetic
agtaaggcctctggggctga

SEQ ID NO: 2466 - DNA, 20 bp, Artificial Sequence
  Synthetic
gtaaggcctctggggctgag

SEQ ID NO: 2467 - DNA, 20 bp, Artificial Sequence
  Synthetic
taaggcctctggggctgagg

SEQ ID NO: 2468 - DNA, 20 bp, Artificial Sequence
  Synthetic
ggcctctggggctgaggggg

SEQ ID NO: 2469 - DNA, 20 bp, Artificial Sequence
  Synthetic
gcctctggggctgagggggt

SEQ ID NO: 2470 - DNA, 20 bp, Artificial Sequence
  Synthetic
tcccaccccctcagccccag

SEQ ID NO: 2471 - DNA, 20 bp, Artificial Sequence
  Synthetic
ctgagggggtgggaagccag

SEQ ID NO: 2472 - DNA, 20 bp, Artificial Sequence
  Synthetic
tgagggggtgggaagccagt

SEQ ID NO: 2473 - DNA, 20 bp, Artificial Sequence
  Synthetic
gggggtgggaagccagtggg

SEQ ID NO: 2474 - DNA, 20 bp, Artificial Sequence
  Synthetic
ggtgggaagccagtgggtgg

SEQ ID NO: 2475 - DNA, 20 bp, Artificial Sequence
  Synthetic
ttgcaggttccgccacccac

SEQ ID NO: 2476 - DNA, 20 bp, Artificial Sequence
  Synthetic
atttggggcggatttcttgc

SEQ ID NO: 2477 - DNA, 20 bp, Artificial Sequence
  Synthetic
agaaatccgccccaaattta

SEQ ID NO: 2478 - DNA, 20 bp, Artificial Sequence
  Synthetic
atgcttccttaaatttgggg

SEQ ID NO: 2479 - DNA, 20 bp, Artificial Sequence
  Synthetic
ccccaaatttaaggaagcat

SEQ ID NO: 2480 - DNA, 20 bp, Artificial Sequence
  Synthetic
cctatgcttccttaaatttg

SEQ ID NO: 2481 - DNA, 20 bp, Artificial Sequence
  Synthetic
tcctatgcttccttaaattt

SEQ ID NO: 2482 - DNA, 20 bp, Artificial Sequence
  Synthetic
ttcctatgcttccttaaatt

SEQ ID NO: 2483 - DNA, 20 bp, Artificial Sequence
  Synthetic
cctaccctatgtctgccttg

SEQ ID NO: 2484 - DNA, 20 bp, Artificial Sequence
  Synthetic
ccacaaggcagacatagggt

SEQ ID NO: 2485 - DNA, 20 bp, Artificial Sequence
  Synthetic
ctagccacaaggcagacata

SEQ ID NO: 2486 - DNA, 20 bp, Artificial Sequence
  Synthetic
cctatgtctgccttgtggct

SEQ ID NO: 2487 - DNA, 20 bp, Artificial Sequence
  Synthetic
cctagccacaaggcagacat

SEQ ID NO: 2488 - DNA, 20 bp, Artificial Sequence
  Synthetic
gaactaaggacctagccaca

SEQ ID NO: 2489 - DNA, 20 bp, Artificial Sequence
  Synthetic
tccttagttcattgtctctt

SEQ ID NO: 2490 - DNA, 20 bp, Artificial Sequence
  Synthetic
acctaagagacaatgaacta

SEQ ID NO: 2491 - DNA, 20 bp, Artificial Sequence
  Synthetic
ttctactctcaagagaatct

SEQ ID NO: 2492 - DNA, 20 bp, Artificial Sequence
  Synthetic
cttctactctcaagagaatc

SEQ ID NO: 2493 - DNA, 20 bp, Artificial Sequence
  Synthetic
cagattctcttgagagtaga

SEQ ID NO: 2494 - DNA, 20 bp, Artificial Sequence
  Synthetic
attctcttgagagtagaagg

SEQ ID NO: 2495 - DNA, 20 bp, Artificial Sequence
  Synthetic
tctcggatttgttaatcagg

SEQ ID NO: 2496 - DNA, 20 bp, Artificial Sequence
  Synthetic
tcctgattaacaaatccgag

SEQ ID NO: 2497 - DNA, 20 bp, Artificial Sequence
  Synthetic
acctctcggatttgttaatc

SEQ ID NO: 2498 - DNA, 20 bp, Artificial Sequence
  Synthetic
ttcatgagattagcacctct

SEQ ID NO: 2499 - DNA, 20 bp, Artificial Sequence
  Synthetic
gctaatctcatgaattctcc

SEQ ID NO: 2500 - DNA, 20 bp, Artificial Sequence
  Synthetic
tcatgaattctcccggacta

SEQ ID NO: 2501 - DNA, 20 bp, Artificial Sequence
  Synthetic
gctatatataaccatagtcc

SEQ ID NO: 2502 - DNA, 20 bp, Artificial Sequence
  Synthetic
agctatatataaccatagtc

SEQ ID NO: 2503 - DNA, 20 bp, Artificial Sequence
  Synthetic
tcagtgatctcatgtagctt

SEQ ID NO: 2504 - DNA, 20 bp, Artificial Sequence
  Synthetic
tgatctcatgtagcttaggc

SEQ ID NO: 2505 - DNA, 20 bp, Artificial Sequence
  Synthetic
ctcatgtagcttaggctggc

SEQ ID NO: 2506 - DNA, 20 bp, Artificial Sequence
  Synthetic
ttgagctcactatgaagcaa

SEQ ID NO: 2507 - DNA, 20 bp, Artificial Sequence
  Synthetic
aaggatgaccctgaacttct

SEQ ID NO: 2508 - DNA, 20 bp, Artificial Sequence
  Synthetic
caggaaaaccaagaagttca

SEQ ID NO: 2509 - DNA, 20 bp, Artificial Sequence
  Synthetic
gcaggaaaaccaagaagttc

SEQ ID NO: 2510 - DNA, 20 bp, Artificial Sequence
  Synthetic
agcacttggaagatgaaagc

SEQ ID NO: 2511 - DNA, 20 bp, Artificial Sequence
  Synthetic
attcttgtaatcgcagcact

SEQ ID NO: 2512 - DNA, 20 bp, Artificial Sequence
  Synthetic
gctgccatgtctagttcatg

SEQ ID NO: 2513 - DNA, 20 bp, Artificial Sequence
  Synthetic
agcaccacatgaactagaca

SEQ ID NO: 2514 - DNA, 20 bp, Artificial Sequence
  Synthetic
tgtctagttcatgtggtgct

SEQ ID NO: 2515 - DNA, 20 bp, Artificial Sequence
  Synthetic
gtctagttcatgtggtgcta

SEQ ID NO: 2516 - DNA, 20 bp, Artificial Sequence
  Synthetic
ggtgctagggatcaaccctg

SEQ ID NO: 2517 - DNA, 20 bp, Artificial Sequence
  Synthetic
ttaacatgcacaaagcctca

SEQ ID NO: 2518 - DNA, 20 bp, Artificial Sequence
  Synthetic
cttaacatgcacaaagcctc

SEQ ID NO: 2519 - DNA, 20 bp, Artificial Sequence
  Synthetic
attcttttgagtcagggtca

SEQ ID NO: 2520 - DNA, 20 bp, Artificial Sequence
  Synthetic
tattcttttgagtcagggtc

SEQ ID NO: 2521 - DNA, 20 bp, Artificial Sequence
  Synthetic
tgaccctgactcaaaagaat

SEQ ID NO: 2522 - DNA, 20 bp, Artificial Sequence
  Synthetic
gaccctgactcaaaagaata

SEQ ID NO: 2523 - DNA, 20 bp, Artificial Sequence
  Synthetic
accctgactcaaaagaatag

SEQ ID NO: 2524 - DNA, 20 bp, Artificial Sequence
  Synthetic
ccctgactcaaaagaatagg

SEQ ID NO: 2525 - DNA, 20 bp, Artificial Sequence
  Synthetic
ccccctattcttttgagtca

SEQ ID NO: 2526 - DNA, 20 bp, Artificial Sequence
  Synthetic
cctgactcaaaagaataggg

SEQ ID NO: 2527 - DNA, 20 bp, Artificial Sequence
  Synthetic
cccccctattcttttgagtc

SEQ ID NO: 2528 - DNA, 20 bp, Artificial Sequence
  Synthetic
ctgactcaaaagaatagggg

SEQ ID NO: 2529 - DNA, 20 bp, Artificial Sequence
  Synthetic
actcaaaagaataggggggg

SEQ ID NO: 2530 - DNA, 20 bp, Artificial Sequence
  Synthetic
aaaagaatagggggggagga

SEQ ID NO: 2531 - DNA, 20 bp, Artificial Sequence
  Synthetic
gaatagggggggaggaagga

SEQ ID NO: 2532 - DNA, 20 bp, Artificial Sequence
  Synthetic
agggggggaggaaggaagga

SEQ ID NO: 2533 - DNA, 20 bp, Artificial Sequence
  Synthetic
ggggaggaaggaaggaagga

SEQ ID NO: 2534 - DNA, 20 bp, Artificial Sequence
  Synthetic
aggaaggaaggaaggaagga

SEQ ID NO: 2535 - DNA, 20 bp, Artificial Sequence
  Synthetic
aggaaggaaggaaggaagga

SEQ ID NO: 2536 - DNA, 20 bp, Artificial Sequence
  Synthetic
ggaaggaaggaaggaaggaa

SEQ ID NO: 2537 - DNA, 20 bp, Artificial Sequence
  Synthetic
aggaaggaaggaaggaaggg

SEQ ID NO: 2538 - DNA, 20 bp, Artificial Sequence
  Synthetic
ggaaggaaggaaggaaggga

SEQ ID NO: 2539 - DNA, 20 bp, Artificial Sequence
  Synthetic
aggaaggaaggaagggaggg

SEQ ID NO: 2540 - DNA, 20 bp, Artificial Sequence
  Synthetic
ggaaggaaggaagggaggga

SEQ ID NO: 2541 - DNA, 20 bp, Artificial Sequence
  Synthetic
aggaaggaagggagggaggg

SEQ ID NO: 2542 - DNA, 20 bp, Artificial Sequence
  Synthetic
ggaaggaagggagggaggga

SEQ ID NO: 2543 - DNA, 20 bp, Artificial Sequence
  Synthetic
aggaagggagggagggaggg

SEQ ID NO: 2544 - DNA, 20 bp, Artificial Sequence
  Synthetic
ggaagggagggagggaggga

SEQ ID NO: 2545 - DNA, 20 bp, Artificial Sequence
  Synthetic
agggagggagggagggaggg

SEQ ID NO: 2546 - DNA, 20 bp, Artificial Sequence
  Synthetic
gggagggagggagggaggga

SEQ ID NO: 2547 - DNA, 20 bp, Artificial Sequence
  Synthetic
agggagggagggagggaggg

SEQ ID NO: 2548 - DNA, 20 bp, Artificial Sequence
  Synthetic
gggagggagggagggaggga

SEQ ID NO: 2549 - DNA, 20 bp, Artificial Sequence
  Synthetic
agggagggagggagggaggg

SEQ ID NO: 2550 - DNA, 20 bp, Artificial Sequence
  Synthetic
gggagggagggagggaggga

SEQ ID NO: 2551 - DNA, 20 bp, Artificial Sequence
  Synthetic
agggagggagggagggaggg

SEQ ID NO: 2552 - DNA, 20 bp, Artificial Sequence
  Synthetic
gggagggagggagggaggga

SEQ ID NO: 2553 - DNA, 20 bp, Artificial Sequence
  Synthetic
agggagggagggagggaggg

SEQ ID NO: 2554 - DNA, 20 bp, Artificial Sequence
  Synthetic
gggagggagggagggaggga

SEQ ID NO: 2555 - DNA, 20 bp, Artificial Sequence
  Synthetic
agggagggagggagggaggg

SEQ ID NO: 2556 - DNA, 20 bp, Artificial Sequence
  Synthetic
agggagggagggagggagga

SEQ ID NO: 2557 - DNA, 20 bp, Artificial Sequence
  Synthetic
gatgttgagaacaaaagcca

SEQ ID NO: 2558 - DNA, 20 bp, Artificial Sequence
  Synthetic
gaacaaaagccaaggccaac

SEQ ID NO: 2559 - DNA, 20 bp, Artificial Sequence
  Synthetic
gccaaggccaacaggtgagt

SEQ ID NO: 2560 - DNA, 20 bp, Artificial Sequence
  Synthetic
ccaaggccaacaggtgagtt

SEQ ID NO: 2561 - DNA, 20 bp, Artificial Sequence
  Synthetic
cccaactcacctgttggcct

SEQ ID NO: 2562 - DNA, 20 bp, Artificial Sequence
  Synthetic
ccaacaggtgagttgggatt

SEQ ID NO: 2563 - DNA, 20 bp, Artificial Sequence
  Synthetic
cctaatcccaactcacctgt

SEQ ID NO: 2564 - DNA, 20 bp, Artificial Sequence
  Synthetic
aaaagtccttttcatagcaa

SEQ ID NO: 2565 - DNA, 20 bp, Artificial Sequence
  Synthetic
aaagtccttttcatagcaaa

SEQ ID NO: 2566 - DNA, 20 bp, Artificial Sequence
  Synthetic
aagtccttttcatagcaaag

SEQ ID NO: 2567 - DNA, 20 bp, Artificial Sequence
  Synthetic
acatcccctttgctatgaaa

SEQ ID NO: 2568 - DNA, 20 bp, Artificial Sequence
  Synthetic
ttttcatagcaaaggggatg

SEQ ID NO: 2569 - DNA, 20 bp, Artificial Sequence
  Synthetic
gtggaagaagagaagttgac

SEQ ID NO: 2570 - DNA, 20 bp, Artificial Sequence
  Synthetic
agagaagttgacaggtaagt

SEQ ID NO: 2571 - DNA, 20 bp, Artificial Sequence
  Synthetic
gagaagttgacaggtaagta

SEQ ID NO: 2572 - DNA, 20 bp, Artificial Sequence
  Synthetic
agaaaaaagaaaaaaatctg

SEQ ID NO: 2573 - DNA, 20 bp, Artificial Sequence
  Synthetic
aagaaaaaaatctgtggacc

SEQ ID NO: 2574 - DNA, 20 bp, Artificial Sequence
  Synthetic
agaaaaaaatctgtggacca

SEQ ID NO: 2575 - DNA, 20 bp, Artificial Sequence
  Synthetic
aaaatctgtggaccagggca

SEQ ID NO: 2576 - DNA, 20 bp, Artificial Sequence
  Synthetic
ctgcgtttcttgccatgccc

SEQ ID NO: 2577 - DNA, 20 bp, Artificial Sequence
  Synthetic
gagcaaatgttcataaagag

SEQ ID NO: 2578 - DNA, 20 bp, Artificial Sequence
  Synthetic
caaatgttcataaagagagg

SEQ ID NO: 2579 - DNA, 20 bp, Artificial Sequence
  Synthetic
aaatgttcataaagagaggt

SEQ ID NO: 2580 - DNA, 20 bp, Artificial Sequence
  Synthetic
gttcataaagagaggtgggc

SEQ ID NO: 2581 - DNA, 20 bp, Artificial Sequence
  Synthetic
cataaagagaggtgggcagg

SEQ ID NO: 2582 - DNA, 20 bp, Artificial Sequence
  Synthetic
ggtgggcaggaggcagacca

SEQ ID NO: 2583 - DNA, 20 bp, Artificial Sequence
  Synthetic
tctgatgagtcttgagacca

SEQ ID NO: 2584 - DNA, 20 bp, Artificial Sequence
  Synthetic
caagactcatcagagagata

SEQ ID NO: 2585 - DNA, 20 bp, Artificial Sequence
  Synthetic
agagataaggcaatatcctg

SEQ ID NO: 2586 - DNA, 20 bp, Artificial Sequence
  Synthetic
tcctgaggagcacccatctg

SEQ ID NO: 2587 - DNA, 20 bp, Artificial Sequence
  Synthetic
cctgaggagcacccatctga

SEQ ID NO: 2588 - DNA, 20 bp, Artificial Sequence
  Synthetic
ccctcagatgggtgctcctc

SEQ ID NO: 2589 - DNA, 20 bp, Artificial Sequence
  Synthetic
ctgaggagcacccatctgag

SEQ ID NO: 2590 - DNA, 20 bp, Artificial Sequence
  Synthetic
ttgctcaacgcccctcagat

SEQ ID NO: 2591 - DNA, 20 bp, Artificial Sequence
  Synthetic
cttgctcaacgcccctcaga

SEQ ID NO: 2592 - DNA, 20 bp, Artificial Sequence
  Synthetic
tctgaggggcgttgagcaag

SEQ ID NO: 2593 - DNA, 20 bp, Artificial Sequence
  Synthetic
ctgaggggcgttgagcaagt

SEQ ID NO: 2594 - DNA, 20 bp, Artificial Sequence
  Synthetic
catttctctgcattcacaga

SEQ ID NO: 2595 - DNA, 20 bp, Artificial Sequence
  Synthetic
ttctctgcattcacagatgg

SEQ ID NO: 2596 - DNA, 20 bp, Artificial Sequence
  Synthetic
tgcaactatctttagcagtg

SEQ ID NO: 2597 - DNA, 20 bp, Artificial Sequence
  Synthetic
tctttagcagtgaggcatgc

SEQ ID NO: 2598 - DNA, 20 bp, Artificial Sequence
  Synthetic
ctttagcagtgaggcatgct

SEQ ID NO: 2599 - DNA, 20 bp, Artificial Sequence
  Synthetic
atgctgggtagtgctaagag

SEQ ID NO: 2600 - DNA, 20 bp, Artificial Sequence
  Synthetic
tgctgggtagtgctaagagc

SEQ ID NO: 2601 - DNA, 20 bp, Artificial Sequence
  Synthetic
tgggtagtgctaagagcggg

SEQ ID NO: 2602 - DNA, 20 bp, Artificial Sequence
  Synthetic
gggtagtgctaagagcgggc

SEQ ID NO: 2603 - DNA, 20 bp, Artificial Sequence
  Synthetic
ggtagtgctaagagcgggcg

SEQ ID NO: 2604 - DNA, 20 bp, Artificial Sequence
  Synthetic
ctaagagcgggcggggtctg

SEQ ID NO: 2605 - DNA, 20 bp, Artificial Sequence
  Synthetic
agcgggcggggtctgtggaa

SEQ ID NO: 2606 - DNA, 20 bp, Artificial Sequence
  Synthetic
gcggggtctgtggaatggag

SEQ ID NO: 2607 - DNA, 20 bp, Artificial Sequence
  Synthetic
aatgacgtggtaataaggag

SEQ ID NO: 2608 - DNA, 20 bp, Artificial Sequence
  Synthetic
agtaaaatgacgtggtaata

SEQ ID NO: 2609 - DNA, 20 bp, Artificial Sequence
  Synthetic
taatcaaaagtaaaatgacg

SEQ ID NO: 2610 - DNA, 20 bp, Artificial Sequence
  Synthetic
ctatgtatcttgcctcttga

SEQ ID NO: 2611 - DNA, 20 bp, Artificial Sequence
  Synthetic
gtacttgtgtgaccgtcaag

SEQ ID NO: 2612 - DNA, 20 bp, Artificial Sequence
  Synthetic
agtacttccagttgaagagt

SEQ ID NO: 2613 - DNA, 20 bp, Artificial Sequence
  Synthetic
tgtaatgcctactcttcaac

SEQ ID NO: 2614 - DNA, 20 bp, Artificial Sequence
  Synthetic
gttgaagagtaggcattaca

SEQ ID NO: 2615 - DNA, 20 bp, Artificial Sequence
  Synthetic
tctgcttccatgaatattct

SEQ ID NO: 2616 - DNA, 20 bp, Artificial Sequence
  Synthetic
ctgcttccatgaatattcta

SEQ ID NO: 2617 - DNA, 20 bp, Artificial Sequence
  Synthetic
aatgtgccctagaatattca

SEQ ID NO: 2618 - DNA, 20 bp, Artificial Sequence
  Synthetic
ctagggcacatttttattcc

SEQ ID NO: 2619 - DNA, 20 bp, Artificial Sequence
  Synthetic
tgctttcatatattttttcc

SEQ ID NO: 2620 - DNA, 20 bp, Artificial Sequence
  Synthetic
aaagcatttctaattatgaa

SEQ ID NO: 2621 - DNA, 20 bp, Artificial Sequence
  Synthetic
tttctaattatgaatggaat

SEQ ID NO: 2622 - DNA, 20 bp, Artificial Sequence
  Synthetic
ctaattatgaatggaattgg

SEQ ID NO: 2623 - DNA, 20 bp, Artificial Sequence
  Synthetic
tgaatggaattggtggttta

SEQ ID NO: 2624 - DNA, 20 bp, Artificial Sequence
  Synthetic
gaatggaattggtggtttat

SEQ ID NO: 2625 - DNA, 20 bp, Artificial Sequence
  Synthetic
aatggaattggtggtttatg

SEQ ID NO: 2626 - DNA, 20 bp, Artificial Sequence
  Synthetic
ggaacacatatgctcagcct

SEQ ID NO: 2627 - DNA, 20 bp, Artificial Sequence
  Synthetic
ggttttggtaatttattcca

SEQ ID NO: 2628 - DNA, 20 bp, Artificial Sequence
  Synthetic
ataaattaccaaaaccaaag

SEQ ID NO: 2629 - DNA, 20 bp, Artificial Sequence
  Synthetic
gagtctagcctctttggttt

SEQ ID NO: 2630 - DNA, 20 bp, Artificial Sequence
  Synthetic
agaagggagtctagcctctt

SEQ ID NO: 2631 - DNA, 20 bp, Artificial Sequence
  Synthetic
gcttctgttgatcggtagaa

SEQ ID NO: 2632 - DNA, 20 bp, Artificial Sequence
  Synthetic
tgcttctgttgatcggtaga

SEQ ID NO: 2633 - DNA, 20 bp, Artificial Sequence
  Synthetic
tcttatatgcttctgttgat

SEQ ID NO: 2634 - DNA, 20 bp, Artificial Sequence
  Synthetic
caacagaagcatataagagt

SEQ ID NO: 2635 - DNA, 20 bp, Artificial Sequence
  Synthetic
ttctctactctaccaacttg

SEQ ID NO: 2636 - DNA, 20 bp, Artificial Sequence
  Synthetic
ctactctaccaacttgtggt

SEQ ID NO: 2637 - DNA, 20 bp, Artificial Sequence
  Synthetic
tactctaccaacttgtggtt

SEQ ID NO: 2638 - DNA, 20 bp, Artificial Sequence
  Synthetic
aacaggacccaaccacaagt

SEQ ID NO: 2639 - DNA, 20 bp, Artificial Sequence
  Synthetic
gtcctgtttagaataataag

SEQ ID NO: 2640 - DNA, 20 bp, Artificial Sequence
  Synthetic
tgcctcttattattctaaac

SEQ ID NO: 2641 - DNA, 20 bp, Artificial Sequence
  Synthetic
gcatctacatgtagagctct

SEQ ID NO: 2642 - DNA, 20 bp, Artificial Sequence
  Synthetic
tctaggaagccattcaatgc

SEQ ID NO: 2643 - DNA, 20 bp, Artificial Sequence
  Synthetic
ggtttagatcctgcattgaa

SEQ ID NO: 2644 - DNA, 20 bp, Artificial Sequence
  Synthetic
tcaatgcaggatctaaacct

SEQ ID NO: 2645 - DNA, 20 bp, Artificial Sequence
  Synthetic
cacagacattgctaaagcca

SEQ ID NO: 2646 - DNA, 20 bp, Artificial Sequence
  Synthetic
tggctttagcaatgtctgtg

SEQ ID NO: 2647 - DNA, 20 bp, Artificial Sequence
  Synthetic
agcaatgtctgtgcggtact

SEQ ID NO: 2648 - DNA, 20 bp, Artificial Sequence
  Synthetic
caaagaaaaccaagatttat

SEQ ID NO: 2649 - DNA, 20 bp, Artificial Sequence
  Synthetic
aaaaccaagatttatcggaa

SEQ ID NO: 2650 - DNA, 20 bp, Artificial Sequence
  Synthetic
accaagatttatcggaatgg

SEQ ID NO: 2651 - DNA, 20 bp, Artificial Sequence
  Synthetic
tccaccattccgataaatct

SEQ ID NO: 2652 - DNA, 20 bp, Artificial Sequence
  Synthetic
ggtggacactgaaagtagac

SEQ ID NO: 2653 - DNA, 20 bp, Artificial Sequence
  Synthetic
acactgaaagtagacaggaa

SEQ ID NO: 2654 - DNA, 20 bp, Artificial Sequence
  Synthetic
cctagtgtgcagtgtgcaga

SEQ ID NO: 2655 - DNA, 20 bp, Artificial Sequence
  Synthetic
ccatctgcacactgcacact

SEQ ID NO: 2656 - DNA, 20 bp, Artificial Sequence
  Synthetic
gtgtgcagtgtgcagatgga

SEQ ID NO: 2657 - DNA, 20 bp, Artificial Sequence
  Synthetic
tgtgcagtgtgcagatggaa

SEQ ID NO: 2658 - DNA, 20 bp, Artificial Sequence
  Synthetic
tgcagatggaagggcagtgc

SEQ ID NO: 2659 - DNA, 20 bp, Artificial Sequence
  Synthetic
gcagatggaagggcagtgct

SEQ ID NO: 2660 - DNA, 20 bp, Artificial Sequence
  Synthetic
cagatggaagggcagtgctg

SEQ ID NO: 2661 - DNA, 20 bp, Artificial Sequence
  Synthetic
tggggagaatccattgcatt

SEQ ID NO: 2662 - DNA, 20 bp, Artificial Sequence
  Synthetic
cttcttctttccaaatgcaa

SEQ ID NO: 2663 - DNA, 20 bp, Artificial Sequence
  Synthetic
ttagcaaaagaaatcgcaga

SEQ ID NO: 2664 - DNA, 20 bp, Artificial Sequence
  Synthetic
attagcaaaagaaatcgcag

SEQ ID NO: 2665 - DNA, 20 bp, Artificial Sequence
  Synthetic
gcgatttcttttgctaatgc

SEQ ID NO: 2666 - DNA, 20 bp, Artificial Sequence
  Synthetic
aagcaagtactacagtgaaa

SEQ ID NO: 2667 - DNA, 20 bp, Artificial Sequence
  Synthetic
ttcactgtagtacttgcttg

SEQ ID NO: 2668 - DNA, 20 bp, Artificial Sequence
  Synthetic
actgtagtacttgcttgtgg

SEQ ID NO: 2669 - DNA, 20 bp, Artificial Sequence
  Synthetic
tgtggtggtttgaatgaaaa

SEQ ID NO: 2670 - DNA, 20 bp, Artificial Sequence
  Synthetic
tgaatgaaaatggtccccac

SEQ ID NO: 2671 - DNA, 20 bp, Artificial Sequence
  Synthetic
gttttcaaaaatagcctgtg

SEQ ID NO: 2672 - DNA, 20 bp, Artificial Sequence
  Synthetic
agttttcaaaaatagcctgt

SEQ ID NO: 2673 - DNA, 20 bp, Artificial Sequence
  Synthetic
aagttttcaaaaatagcctg

SEQ ID NO: 2674 - DNA, 20 bp, Artificial Sequence
  Synthetic
ttgaaaacttgatccccagt

SEQ ID NO: 2675 - DNA, 20 bp, Artificial Sequence
  Synthetic
ccccagttggtgaaactgtt

SEQ ID NO: 2676 - DNA, 20 bp, Artificial Sequence
  Synthetic
ccaaacagtttcaccaactg

SEQ ID NO: 2677 - DNA, 20 bp, Artificial Sequence
  Synthetic
tccaaacagtttcaccaact

SEQ ID NO: 2678 - DNA, 20 bp, Artificial Sequence
  Synthetic
ttccaaacagtttcaccaac

SEQ ID NO: 2679 - DNA, 20 bp, Artificial Sequence
  Synthetic
gttggtgaaactgtttggaa

SEQ ID NO: 2680 - DNA, 20 bp, Artificial Sequence
  Synthetic
gaaactgtttggaaaggatt

SEQ ID NO: 2681 - DNA, 20 bp, Artificial Sequence
  Synthetic
ttggaaaggattaggaagtg

SEQ ID NO: 2682 - DNA, 20 bp, Artificial Sequence
  Synthetic
attaggaagtgtggccttgc

SEQ ID NO: 2683 - DNA, 20 bp, Artificial Sequence
  Synthetic
aagtgtggccttgctggatg

SEQ ID NO: 2684 - DNA, 20 bp, Artificial Sequence
  Synthetic
ttgacagacctcatccagca

SEQ ID NO: 2685 - DNA, 20 bp, Artificial Sequence
  Synthetic
tgctggatgaggtctgtcaa

SEQ ID NO: 2686 - DNA, 20 bp, Artificial Sequence
  Synthetic
tggatgaggtctgtcaatgg

SEQ ID NO: 2687 - DNA, 20 bp, Artificial Sequence
  Synthetic
tgaggtctgtcaatggcgga

SEQ ID NO: 2688 - DNA, 20 bp, Artificial Sequence
  Synthetic
gagacagagagaggcacact

SEQ ID NO: 2689 - DNA, 20 bp, Artificial Sequence
  Synthetic
ggagacagagagaggcacac

SEQ ID NO: 2690 - DNA, 20 bp, Artificial Sequence
  Synthetic
aataagtaggagacagagag

SEQ ID NO: 2691 - DNA, 20 bp, Artificial Sequence
  Synthetic
tcatttttcaatcaataagt

SEQ ID NO: 2692 - DNA, 20 bp, Artificial Sequence
  Synthetic
aattctggatggcagagcaa

SEQ ID NO: 2693 - DNA, 20 bp, Artificial Sequence
  Synthetic
tgggtgattagaattctgga

SEQ ID NO: 2694 - DNA, 20 bp, Artificial Sequence
  Synthetic
gttttgggtgattagaattc

SEQ ID NO: 2695 - DNA, 20 bp, Artificial Sequence
  Synthetic
taattaggctatatggtttt

SEQ ID NO: 2696 - DNA, 20 bp, Artificial Sequence
  Synthetic
ttaattaggctatatggttt

SEQ ID NO: 2697 - DNA, 20 bp, Artificial Sequence
  Synthetic
cagtatttaattaggctata

SEQ ID NO: 2698 - DNA, 20 bp, Artificial Sequence
  Synthetic
tataaaaacagtatttaatt

SEQ ID NO: 2699 - DNA, 20 bp, Artificial Sequence
  Synthetic
actgtttttataagttacct

SEQ ID NO: 2700 - DNA, 20 bp, Artificial Sequence
  Synthetic
tttataagttaccttggtca

SEQ ID NO: 2701 - DNA, 20 bp, Artificial Sequence
  Synthetic
taccttggtcatggtacttt

SEQ ID NO: 2702 - DNA, 20 bp, Artificial Sequence
  Synthetic
atcctaaagtaccatgacca

SEQ ID NO: 2703 - DNA, 20 bp, Artificial Sequence
  Synthetic
tagttaagaaactaagacat

SEQ ID NO: 2704 - DNA, 20 bp, Artificial Sequence
  Synthetic
cttaaccaaaacaccacaga

SEQ ID NO: 2705 - DNA, 20 bp, Artificial Sequence
  Synthetic
ttaaccaaaacaccacagac

SEQ ID NO: 2706 - DNA, 20 bp, Artificial Sequence
  Synthetic
caagcccgtctgtggtgttt

SEQ ID NO: 2707 - DNA, 20 bp, Artificial Sequence
  Synthetic
gtcatatgcaagcccgtctg

SEQ ID NO: 2708 - DNA, 20 bp, Artificial Sequence
  Synthetic
gcatatgacaacagttctag

SEQ ID NO: 2709 - DNA, 20 bp, Artificial Sequence
  Synthetic
ccctgatcaaatgccctagc

SEQ ID NO: 2710 - DNA, 20 bp, Artificial Sequence
  Synthetic
cctgctagggcatttgatca

SEQ ID NO: 2711 - DNA, 20 bp, Artificial Sequence
  Synthetic
acctgctagggcatttgatc

SEQ ID NO: 2712 - DNA, 20 bp, Artificial Sequence
  Synthetic
atcagacacagaacctgcta

SEQ ID NO: 2713 - DNA, 20 bp, Artificial Sequence
  Synthetic
catcagacacagaacctgct

SEQ ID NO: 2714 - DNA, 20 bp, Artificial Sequence
  Synthetic
agcaggttctgtgtctgatg

SEQ ID NO: 2715 - DNA, 20 bp, Artificial Sequence
  Synthetic
gcaggttctgtgtctgatga

SEQ ID NO: 2716 - DNA, 20 bp, Artificial Sequence
  Synthetic
ctgtgtctgatgagggctgc

SEQ ID NO: 2717 - DNA, 20 bp, Artificial Sequence
  Synthetic
tgatgagggctgctggttca

SEQ ID NO: 2718 - DNA, 20 bp, Artificial Sequence
  Synthetic
gatgagggctgctggttcat

SEQ ID NO: 2719 - DNA, 20 bp, Artificial Sequence
  Synthetic
gagggctgctggttcatggg

SEQ ID NO: 2720 - DNA, 20 bp, Artificial Sequence
  Synthetic
ctttttctcagtgtccttac

SEQ ID NO: 2721 - DNA, 20 bp, Artificial Sequence
  Synthetic
tttctcagtgtccttacagg

SEQ ID NO: 2722 - DNA, 20 bp, Artificial Sequence
  Synthetic
tcagtgtccttacaggtgga

SEQ ID NO: 2723 - DNA, 20 bp, Artificial Sequence
  Synthetic
ctggataccttccacctgta

SEQ ID NO: 2724 - DNA, 20 bp, Artificial Sequence
  Synthetic
tggaaggtatccagctttct

SEQ ID NO: 2725 - DNA, 20 bp, Artificial Sequence
  Synthetic
aatataaggtccaagaaagc

SEQ ID NO: 2726 - DNA, 20 bp, Artificial Sequence
  Synthetic
ggaatgcgtgctttaatata

SEQ ID NO: 2727 - DNA, 20 bp, Artificial Sequence
  Synthetic
aagctatctactcacatcaa

SEQ ID NO: 2728 - DNA, 20 bp, Artificial Sequence
  Synthetic
gaggtgcttaaatcactttg

SEQ ID NO: 2729 - DNA, 20 bp, Artificial Sequence
  Synthetic
ggaggtgcttaaatcacttt

SEQ ID NO: 2730 - DNA, 20 bp, Artificial Sequence
  Synthetic
tggaggtgcttaaatcactt

SEQ ID NO: 2731 - DNA, 20 bp, Artificial Sequence
  Synthetic
cctccaaaaccctccgtctc

SEQ ID NO: 2732 - DNA, 20 bp, Artificial Sequence
  Synthetic
ccggagacggagggttttgg

SEQ ID NO: 2733 - DNA, 20 bp, Artificial Sequence
  Synthetic
catccggagacggagggttt

SEQ ID NO: 2734 - DNA, 20 bp, Artificial Sequence
  Synthetic
ggggagcatccggagacgga

SEQ ID NO: 2735 - DNA, 20 bp, Artificial Sequence
  Synthetic
gggggagcatccggagacgg

SEQ ID NO: 2736 - DNA, 20 bp, Artificial Sequence
  Synthetic
aatgggggagcatccggaga

SEQ ID NO: 2737 - DNA, 20 bp, Artificial Sequence
  Synthetic
gtctccggatgctcccccat

SEQ ID NO: 2738 - DNA, 20 bp, Artificial Sequence
  Synthetic
ttcaccaatgggggagcatc

SEQ ID NO: 2739 - DNA, 20 bp, Artificial Sequence
  Synthetic
tgaaatctgttcaccaatgg

SEQ ID NO: 2740 - DNA, 20 bp, Artificial Sequence
  Synthetic
ttgaaatctgttcaccaatg

SEQ ID NO: 2741 - DNA, 20 bp, Artificial Sequence
  Synthetic
gttgaaatctgttcaccaat

SEQ ID NO: 2742 - DNA, 20 bp, Artificial Sequence
  Synthetic
tgttgaaatctgttcaccaa

SEQ ID NO: 2743 - DNA, 20 bp, Artificial Sequence
  Synthetic
tttcaacatagcaattgagc

SEQ ID NO: 2744 - DNA, 20 bp, Artificial Sequence
  Synthetic
caacatagcaattgagcagg

SEQ ID NO: 2745 - DNA, 20 bp, Artificial Sequence
  Synthetic
tagcaattgagcaggaggaa

SEQ ID NO: 2746 - DNA, 20 bp, Artificial Sequence
  Synthetic
ctggctgtgatcaaataatt

SEQ ID NO: 2747 - DNA, 20 bp, Artificial Sequence
  Synthetic
tttgatcacagccagtactt

SEQ ID NO: 2748 - DNA, 20 bp, Artificial Sequence
  Synthetic
ttgggtgttcaccaaagtac

SEQ ID NO: 2749 - DNA, 20 bp, Artificial Sequence
  Synthetic
gtgaacacccaaacccagca

SEQ ID NO: 2750 - DNA, 20 bp, Artificial Sequence
  Synthetic
ttcagctccatgctgggttt

SEQ ID NO: 2751 - DNA, 20 bp, Artificial Sequence
  Synthetic
attcagctccatgctgggtt

SEQ ID NO: 2752 - DNA, 20 bp, Artificial Sequence
  Synthetic
cagatattcagctccatgct

SEQ ID NO: 2753 - DNA, 20 bp, Artificial Sequence
  Synthetic
acagatattcagctccatgc

SEQ ID NO: 2754 - DNA, 20 bp, Artificial Sequence
  Synthetic
ctgtaatctcagtatccagc

SEQ ID NO: 2755 - DNA, 20 bp, Artificial Sequence
  Synthetic
taatctcagtatccagcagg

SEQ ID NO: 2756 - DNA, 20 bp, Artificial Sequence
  Synthetic
agtatccagcaggtggatat

SEQ ID NO: 2757 - DNA, 20 bp, Artificial Sequence
  Synthetic
gtatccagcaggtggatatt

SEQ ID NO: 2758 - DNA, 20 bp, Artificial Sequence
  Synthetic
tatccagcaggtggatattg

SEQ ID NO: 2759 - DNA, 20 bp, Artificial Sequence
  Synthetic
attccccaatatccacctgc

SEQ ID NO: 2760 - DNA, 20 bp, Artificial Sequence
  Synthetic
attggggaattaagacttca

SEQ ID NO: 2761 - DNA, 20 bp, Artificial Sequence
  Synthetic
taagacttcaaggccagact

SEQ ID NO: 2762 - DNA, 20 bp, Artificial Sequence
  Synthetic
acttactatgtagccaagtc

SEQ ID NO: 2763 - DNA, 20 bp, Artificial Sequence
  Synthetic
tagtaagtttgatgccatcc

SEQ ID NO: 2764 - DNA, 20 bp, Artificial Sequence
  Synthetic
agtaagtttgatgccatcct

SEQ ID NO: 2765 - DNA, 20 bp, Artificial Sequence
  Synthetic
ggatctcatatagcccagga

SEQ ID NO: 2766 - DNA, 20 bp, Artificial Sequence
  Synthetic
aacaggatctcatatagccc

SEQ ID NO: 2767 - DNA, 20 bp, Artificial Sequence
  Synthetic
tatttgggggttttggaaac

SEQ ID NO: 2768 - DNA, 20 bp, Artificial Sequence
  Synthetic
ttgtttctatttgggggttt

SEQ ID NO: 2769 - DNA, 20 bp, Artificial Sequence
  Synthetic
tttttattgtttctatttgg

SEQ ID NO: 2770 - DNA, 20 bp, Artificial Sequence
  Synthetic
ttttttattgtttctatttg

SEQ ID NO: 2771 - DNA, 20 bp, Artificial Sequence
  Synthetic
tttttttattgtttctattt

SEQ ID NO: 2772 - DNA, 20 bp, Artificial Sequence
  Synthetic
atttttttattgtttctatt

SEQ ID NO: 2773 - DNA, 20 bp, Artificial Sequence
  Synthetic
aaatagaaacaataaaaaaa

SEQ ID NO: 2774 - DNA, 20 bp, Artificial Sequence
  Synthetic
tagggtagcagtgaacatga

SEQ ID NO: 2775 - DNA, 20 bp, Artificial Sequence
  Synthetic
atgttcactgctaccctaga

SEQ ID NO: 2776 - DNA, 20 bp, Artificial Sequence
  Synthetic
caagcaaaactgaccttcta

SEQ ID NO: 2777 - DNA, 20 bp, Artificial Sequence
  Synthetic
acaagcaaaactgaccttct

SEQ ID NO: 2778 - DNA, 20 bp, Artificial Sequence
  Synthetic
ttgtaacagatgactaacag

SEQ ID NO: 2779 - DNA, 20 bp, Artificial Sequence
  Synthetic
agatgactaacagaggaaca

SEQ ID NO: 2780 - DNA, 20 bp, Artificial Sequence
  Synthetic
ctaacagaggaacaaggtcc

SEQ ID NO: 2781 - DNA, 20 bp, Artificial Sequence
  Synthetic
agcatactggtagctcttcc

SEQ ID NO: 2782 - DNA, 20 bp, Artificial Sequence
  Synthetic
cagcatactggtagctcttc

SEQ ID NO: 2783 - DNA, 20 bp, Artificial Sequence
  Synthetic
cggaagagctaccagtatgc

SEQ ID NO: 2784 - DNA, 20 bp, Artificial Sequence
  Synthetic
ttcattggcagccagcatac

SEQ ID NO: 2785 - DNA, 20 bp, Artificial Sequence
  Synthetic
taagacttcagcagcttcat

SEQ ID NO: 2786 - DNA, 20 bp, Artificial Sequence
  Synthetic
gctgaagtcttagtagattt

SEQ ID NO: 2787 - DNA, 20 bp, Artificial Sequence
  Synthetic
cttagtagatttaggagcta

SEQ ID NO: 2788 - DNA, 20 bp, Artificial Sequence
  Synthetic
ctggggctgtgatggaagtc

SEQ ID NO: 2789 - DNA, 20 bp, Artificial Sequence
  Synthetic
tggtggtgctggggctgtga

SEQ ID NO: 2790 - DNA, 20 bp, Artificial Sequence
  Synthetic
tcacagccccagcaccacca

SEQ ID NO: 2791 - DNA, 20 bp, Artificial Sequence
  Synthetic
cacagccccagcaccaccat

SEQ ID NO: 2792 - DNA, 20 bp, Artificial Sequence
  Synthetic
cagtgcccatggtggtgctg

SEQ ID NO: 2793 - DNA, 20 bp, Artificial Sequence
  Synthetic
gcagtgcccatggtggtgct

SEQ ID NO: 2794 - DNA, 20 bp, Artificial Sequence
  Synthetic
ggcagtgcccatggtggtgc

SEQ ID NO: 2795 - DNA, 20 bp, Artificial Sequence
  Synthetic
ctgctgggcagtgcccatgg

SEQ ID NO: 2796 - DNA, 20 bp, Artificial Sequence
  Synthetic
agactgctgggcagtgccca

SEQ ID NO: 2797 - DNA, 20 bp, Artificial Sequence
  Synthetic
ctaaaagaagatagactgct

SEQ ID NO: 2798 - DNA, 20 bp, Artificial Sequence
  Synthetic
ccagcagtctatcttctttt

SEQ ID NO: 2799 - DNA, 20 bp, Artificial Sequence
  Synthetic
cctaaaagaagatagactgc

SEQ ID NO: 2800 - DNA, 20 bp, Artificial Sequence
  Synthetic
ctatcttcttttaggtcttc

SEQ ID NO: 2801 - DNA, 20 bp, Artificial Sequence
  Synthetic
tttaggtcttcaggtgtccc

SEQ ID NO: 2802 - DNA, 20 bp, Artificial Sequence
  Synthetic
ttaggtcttcaggtgtccct

SEQ ID NO: 2803 - DNA, 20 bp, Artificial Sequence
  Synthetic
gtgtccctgggtagagaaca

SEQ ID NO: 2804 - DNA, 20 bp, Artificial Sequence
  Synthetic
gaagccttgttctctaccca

SEQ ID NO: 2805 - DNA, 20 bp, Artificial Sequence
  Synthetic
agaagccttgttctctaccc

SEQ ID NO: 2806 - DNA, 20 bp, Artificial Sequence
  Synthetic
aacaaggcttctgcttgcat

SEQ ID NO: 2807 - DNA, 20 bp, Artificial Sequence
  Synthetic
acaaggcttctgcttgcata

SEQ ID NO: 2808 - DNA, 20 bp, Artificial Sequence
  Synthetic
gtgagactgtcactgtactg

SEQ ID NO: 2809 - DNA, 20 bp, Artificial Sequence
  Synthetic
tgtgagactgtcactgtact

SEQ ID NO: 2810 - DNA, 20 bp, Artificial Sequence
  Synthetic
ttgtgagactgtcactgtac

SEQ ID NO: 2811 - DNA, 20 bp, Artificial Sequence
  Synthetic
tcacaatgagtgcagcaatg

SEQ ID NO: 2812 - DNA, 20 bp, Artificial Sequence
  Synthetic
gcagcaatgtggccacagaa

SEQ ID NO: 2813 - DNA, 20 bp, Artificial Sequence
  Synthetic
cagcaatgtggccacagaac

SEQ ID NO: 2814 - DNA, 20 bp, Artificial Sequence
  Synthetic
agcaatgtggccacagaacg

SEQ ID NO: 2815 - DNA, 20 bp, Artificial Sequence
  Synthetic
acacacatttccccgttctg

SEQ ID NO: 2816 - DNA, 20 bp, Artificial Sequence
  Synthetic
tcaagctgaaagcttttcac

SEQ ID NO: 2817 - DNA, 20 bp, Artificial Sequence
  Synthetic
tctcttgctaaatgacaaag

SEQ ID NO: 2818 - DNA, 20 bp, Artificial Sequence
  Synthetic
ctaaatgacaaagtggttag

SEQ ID NO: 2819 - DNA, 20 bp, Artificial Sequence
  Synthetic
aatgacaaagtggttagagg

SEQ ID NO: 2820 - DNA, 20 bp, Artificial Sequence
  Synthetic
atgacaaagtggttagagga

SEQ ID NO: 2821 - DNA, 20 bp, Artificial Sequence
  Synthetic
gtgtagacaatgaaagctgt

SEQ ID NO: 2822 - DNA, 20 bp, Artificial Sequence
  Synthetic
agctttcattgtctacactc

SEQ ID NO: 2823 - DNA, 20 bp, Artificial Sequence
  Synthetic
tcttttgagaattttacagt

SEQ ID NO: 2824 - DNA, 20 bp, Artificial Sequence
  Synthetic
ctagtcaacacagaaataaa

SEQ ID NO: 2825 - DNA, 20 bp, Artificial Sequence
  Synthetic
tttgttttgttgaaaagaag

SEQ ID NO: 2826 - DNA, 20 bp, Artificial Sequence
  Synthetic
ttgttttgttgaaaagaagt

SEQ ID NO: 2827 - DNA, 20 bp, Artificial Sequence
  Synthetic
tgttttgttgaaaagaagtg

SEQ ID NO: 2828 - DNA, 20 bp, Artificial Sequence
  Synthetic
gttttgttgaaaagaagtgg

SEQ ID NO: 2829 - DNA, 20 bp, Artificial Sequence
  Synthetic
ttgaaaagaagtgggggttt

SEQ ID NO: 2830 - DNA, 20 bp, Artificial Sequence
  Synthetic
tgggggttttggtactgatg

SEQ ID NO: 2831 - DNA, 20 bp, Artificial Sequence
  Synthetic
gggggttttggtactgatga

SEQ ID NO: 2832 - DNA, 20 bp, Artificial Sequence
  Synthetic
ggggttttggtactgatgag

SEQ ID NO: 2833 - DNA, 20 bp, Artificial Sequence
  Synthetic
tatgttacttattcattctc

SEQ ID NO: 2834 - DNA, 20 bp, Artificial Sequence
  Synthetic
cttattcattctcaggttca

SEQ ID NO: 2835 - DNA, 20 bp, Artificial Sequence
  Synthetic
ttaatctatcatttgtcata

SEQ ID NO: 2836 - DNA, 20 bp, Artificial Sequence
  Synthetic
taataaaagcatgcaaatgc

SEQ ID NO: 2837 - DNA, 20 bp, Artificial Sequence
  Synthetic
tgcaaatgctggagctctgc

SEQ ID NO: 2838 - DNA, 20 bp, Artificial Sequence
  Synthetic
aaatgctggagctctgctgg

SEQ ID NO: 2839 - DNA, 20 bp, Artificial Sequence
  Synthetic
ggcggagtacctgatatgca

SEQ ID NO: 2840 - DNA, 20 bp, Artificial Sequence
  Synthetic
gatcttcatccttgcatatc

SEQ ID NO: 2841 - DNA, 20 bp, Artificial Sequence
  Synthetic
gcttttttatttgatttctg

SEQ ID NO: 2842 - DNA, 20 bp, Artificial Sequence
  Synthetic
agcttttttatttgatttct

SEQ ID NO: 2843 - DNA, 20 bp, Artificial Sequence
  Synthetic
cagcttttttatttgatttc

SEQ ID NO: 2844 - DNA, 20 bp, Artificial Sequence
  Synthetic
cagaaatcaaataaaaaagc

SEQ ID NO: 2845 - DNA, 20 bp, Artificial Sequence
  Synthetic
agaaatcaaataaaaaagct

SEQ ID NO: 2846 - DNA, 20 bp, Artificial Sequence
  Synthetic
taaaaaagctgggcatagtg

SEQ ID NO: 2847 - DNA, 20 bp, Artificial Sequence
  Synthetic
agctgggcatagtgaggaag

SEQ ID NO: 2848 - DNA, 20 bp, Artificial Sequence
  Synthetic
gcatagtgaggaagaggaga

SEQ ID NO: 2849 - DNA, 20 bp, Artificial Sequence
  Synthetic
catagtgaggaagaggagat

SEQ ID NO: 2850 - DNA, 20 bp, Artificial Sequence
  Synthetic
agtgaggaagaggagatggg

SEQ ID NO: 2851 - DNA, 20 bp, Artificial Sequence
  Synthetic
aggagatgggaggattcctg

SEQ ID NO: 2852 - DNA, 20 bp, Artificial Sequence
  Synthetic
gatgggaggattcctgtggc

SEQ ID NO: 2853 - DNA, 20 bp, Artificial Sequence
  Synthetic
ggaggattcctgtggctggc

SEQ ID NO: 2854 - DNA, 20 bp, Artificial Sequence
  Synthetic
ttagctgtccagccagccac

SEQ ID NO: 2855 - DNA, 20 bp, Artificial Sequence
  Synthetic
tggaaatagatgaataggct

SEQ ID NO: 2856 - DNA, 20 bp, Artificial Sequence
  Synthetic
tagcctattcatctatttcc

SEQ ID NO: 2857 - DNA, 20 bp, Artificial Sequence
  Synthetic
tggcctggaaatagatgaat

SEQ ID NO: 2858 - DNA, 20 bp, Artificial Sequence
  Synthetic
catctatttccaggccacta

SEQ ID NO: 2859 - DNA, 20 bp, Artificial Sequence
  Synthetic
atctatttccaggccactaa

SEQ ID NO: 2860 - DNA, 20 bp, Artificial Sequence
  Synthetic
atttccaggccactaaggga

SEQ ID NO: 2861 - DNA, 20 bp, Artificial Sequence
  Synthetic
ggtaccatcccttagtggcc

SEQ ID NO: 2862 - DNA, 20 bp, Artificial Sequence
  Synthetic
tttaaggtaccatcccttag

SEQ ID NO: 2863 - DNA, 20 bp, Artificial Sequence
  Synthetic
attattattgttatttttta

SEQ ID NO: 2864 - DNA, 20 bp, Artificial Sequence
  Synthetic
acaataataataaataaaaa

SEQ ID NO: 2865 - DNA, 20 bp, Artificial Sequence
  Synthetic
taataaataaaaaaggtagc

SEQ ID NO: 2866 - DNA, 20 bp, Artificial Sequence
  Synthetic
aaaaaggtagctggttcctg

SEQ ID NO: 2867 - DNA, 20 bp, Artificial Sequence
  Synthetic
tggttcctgaggagcatcta

SEQ ID NO: 2868 - DNA, 20 bp, Artificial Sequence
  Synthetic
gatatccttagatgctcctc

SEQ ID NO: 2869 - DNA, 20 bp, Artificial Sequence
  Synthetic
gtatgtgcacgtggagttaa

SEQ ID NO: 2870 - DNA, 20 bp, Artificial Sequence
  Synthetic
gtatacagtgtatgtgcacg

SEQ ID NO: 2871 - DNA, 20 bp, Artificial Sequence
  Synthetic
tgcacatacactgtatacac

SEQ ID NO: 2872 - DNA, 20 bp, Artificial Sequence
  Synthetic
tttttttggtaaaacttgat

SEQ ID NO: 2873 - DNA, 20 bp, Artificial Sequence
  Synthetic
tttttttttttttttttttt

SEQ ID NO: 2874 - DNA, 20 bp, Artificial Sequence
  Synthetic
aagaacactttattcactgt

SEQ ID NO: 2875 - DNA, 20 bp, Artificial Sequence
  Synthetic
aacactttattcactgttgg

SEQ ID NO: 2876 - DNA, 20 bp, Artificial Sequence
  Synthetic
acactttattcactgttggt

SEQ ID NO: 2877 - DNA, 20 bp, Artificial Sequence
  Synthetic
ctgttggtgggtatgtaaac

SEQ ID NO: 2878 - DNA, 20 bp, Artificial Sequence
  Synthetic
ctctgtgctgattttcatag

SEQ ID NO: 2879 - DNA, 20 bp, Artificial Sequence
  Synthetic
cactatgaaaatcagcacag

SEQ ID NO: 2880 - DNA, 20 bp, Artificial Sequence
  Synthetic
ttgttttgttggagtgggaa

SEQ ID NO: 2881 - DNA, 20 bp, Artificial Sequence
  Synthetic
tttgttttgttggagtggga

SEQ ID NO: 2882 - DNA, 20 bp, Artificial Sequence
  Synthetic
ttgttttgttttgttggagt

SEQ ID NO: 2883 - DNA, 20 bp, Artificial Sequence
  Synthetic
tttgttttgttttgttggag

SEQ ID NO: 2884 - DNA, 20 bp, Artificial Sequence
  Synthetic
tttgttttgttttgttttgt

SEQ ID NO: 2885 - DNA, 20 bp, Artificial Sequence
  Synthetic
gttctagttctagttctaga

SEQ ID NO: 2886 - DNA, 20 bp, Artificial Sequence
  Synthetic
agttctagttctagttctag

SEQ ID NO: 2887 - DNA, 20 bp, Artificial Sequence
  Synthetic
ctagaactactgcacgatcc

SEQ ID NO: 2888 - DNA, 20 bp, Artificial Sequence
  Synthetic
gatccaggtttaccactcct

SEQ ID NO: 2889 - DNA, 20 bp, Artificial Sequence
  Synthetic
atacctaggagtggtaaacc

SEQ ID NO: 2890 - DNA, 20 bp, Artificial Sequence
  Synthetic
tttgagtaaatacctaggag

SEQ ID NO: 2891 - DNA, 20 bp, Artificial Sequence
  Synthetic
actcctaggtatttactcaa

SEQ ID NO: 2892 - DNA, 20 bp, Artificial Sequence
  Synthetic
agtcctttgagtaaatacct

SEQ ID NO: 2893 - DNA, 20 bp, Artificial Sequence
  Synthetic
tatacgtcaacctgtgacag

SEQ ID NO: 2894 - DNA, 20 bp, Artificial Sequence
  Synthetic
gtatatgatgcctctgtcac

SEQ ID NO: 2895 - DNA, 20 bp, Artificial Sequence
  Synthetic
cagaggcatcatatacaagc

SEQ ID NO: 2896 - DNA, 20 bp, Artificial Sequence
  Synthetic
agaggcatcatatacaagca

SEQ ID NO: 2897 - DNA, 20 bp, Artificial Sequence
  Synthetic
catcatatacaagcagggag

SEQ ID NO: 2898 - DNA, 20 bp, Artificial Sequence
  Synthetic
catatacaagcagggagtgg

SEQ ID NO: 2899 - DNA, 20 bp, Artificial Sequence
  Synthetic
tgaggggtgggattaaaggc

SEQ ID NO: 2900 - DNA, 20 bp, Artificial Sequence
  Synthetic
tgcctttaatcccacccctc

SEQ ID NO: 2901 - DNA, 20 bp, Artificial Sequence
  Synthetic
ctcctgaggggtgggattaa

SEQ ID NO: 2902 - DNA, 20 bp, Artificial Sequence
  Synthetic
ctttaatcccacccctcagg

SEQ ID NO: 2903 - DNA, 20 bp, Artificial Sequence
  Synthetic
gactctgcctcctgaggggt

SEQ ID NO: 2904 - DNA, 20 bp, Artificial Sequence
  Synthetic
tgactctgcctcctgagggg

SEQ ID NO: 2905 - DNA, 20 bp, Artificial Sequence
  Synthetic
acccctcaggaggcagagtc

SEQ ID NO: 2906 - DNA, 20 bp, Artificial Sequence
  Synthetic
acctgactctgcctcctgag

SEQ ID NO: 2907 - DNA, 20 bp, Artificial Sequence
  Synthetic
tacctgactctgcctcctga

SEQ ID NO: 2908 - DNA, 20 bp, Artificial Sequence
  Synthetic
ctacctgactctgcctcctg

SEQ ID NO: 2909 - DNA, 20 bp, Artificial Sequence
  Synthetic
ggtagatctctgtgagttcg

SEQ ID NO: 2910 - DNA, 20 bp, Artificial Sequence
  Synthetic
ctgtgagttcgaggccagtt

SEQ ID NO: 2911 - DNA, 20 bp, Artificial Sequence
  Synthetic
actcactatgtagaccaaac

SEQ ID NO: 2912 - DNA, 20 bp, Artificial Sequence
  Synthetic
catatggctatatggtctta

SEQ ID NO: 2913 - DNA, 20 bp, Artificial Sequence
  Synthetic
cataagaccatatagccata

SEQ ID NO: 2914 - DNA, 20 bp, Artificial Sequence
  Synthetic
aagaccatatagccatatgg

SEQ ID NO: 2915 - DNA, 20 bp, Artificial Sequence
  Synthetic
agaccatatagccatatgga

SEQ ID NO: 2916 - DNA, 20 bp, Artificial Sequence
  Synthetic
gaccatatagccatatggag

SEQ ID NO: 2917 - DNA, 20 bp, Artificial Sequence
  Synthetic
accatatagccatatggagg

SEQ ID NO: 2918 - DNA, 20 bp, Artificial Sequence
  Synthetic
ccatatagccatatggaggg

SEQ ID NO: 2919 - DNA, 20 bp, Artificial Sequence
  Synthetic
cccccctccatatggctata

SEQ ID NO: 2920 - DNA, 20 bp, Artificial Sequence
  Synthetic
ctcacaatcccccctccata

SEQ ID NO: 2921 - DNA, 20 bp, Artificial Sequence
  Synthetic
gagagaattattaaatgaat

SEQ ID NO: 2922 - DNA, 20 bp, Artificial Sequence
  Synthetic
tatacactgtcttctttcat

SEQ ID NO: 2923 - DNA, 20 bp, Artificial Sequence
  Synthetic
cataggaaaaatgaacagaa

SEQ ID NO: 2924 - DNA, 20 bp, Artificial Sequence
  Synthetic
ataggaaaaatgaacagaaa

SEQ ID NO: 2925 - DNA, 20 bp, Artificial Sequence
  Synthetic
aacagaaagggagagatctt

SEQ ID NO: 2926 - DNA, 20 bp, Artificial Sequence
  Synthetic
acagaaagggagagatcttt

SEQ ID NO: 2927 - DNA, 20 bp, Artificial Sequence
  Synthetic
gaaagggagagatctttggg

SEQ ID NO: 2928 - DNA, 20 bp, Artificial Sequence
  Synthetic
aaagggagagatctttgggt

SEQ ID NO: 2929 - DNA, 20 bp, Artificial Sequence
  Synthetic
aagggagagatctttgggtg

SEQ ID NO: 2930 - DNA, 20 bp, Artificial Sequence
  Synthetic
atacatgacatgaaagcaga

SEQ ID NO: 2931 - DNA, 20 bp, Artificial Sequence
  Synthetic
tacatgacatgaaagcagaa

SEQ ID NO: 2932 - DNA, 20 bp, Artificial Sequence
  Synthetic
acatgacatgaaagcagaag

SEQ ID NO: 2933 - DNA, 20 bp, Artificial Sequence
  Synthetic
agcagaaggggattagttat

SEQ ID NO: 2934 - DNA, 20 bp, Artificial Sequence
  Synthetic
gaaggggattagttattgga

SEQ ID NO: 2935 - DNA, 20 bp, Artificial Sequence
  Synthetic
gggattagttattggaaggc

SEQ ID NO: 2936 - DNA, 20 bp, Artificial Sequence
  Synthetic
ggattagttattggaaggca

SEQ ID NO: 2937 - DNA, 20 bp, Artificial Sequence
  Synthetic
ttagttattggaaggcaggg

SEQ ID NO: 2938 - DNA, 20 bp, Artificial Sequence
  Synthetic
tagttattggaaggcaggga

SEQ ID NO: 2939 - DNA, 20 bp, Artificial Sequence
  Synthetic
tggaaggcagggagggaccc

SEQ ID NO: 2940 - DNA, 20 bp, Artificial Sequence
  Synthetic
aaggcagggagggacccagg

SEQ ID NO: 2941 - DNA, 20 bp, Artificial Sequence
  Synthetic
ggagggacccaggaggatga

SEQ ID NO: 2942 - DNA, 20 bp, Artificial Sequence
  Synthetic
gagggacccaggaggatgaa

SEQ ID NO: 2943 - DNA, 20 bp, Artificial Sequence
  Synthetic
tctcttcccttcatcctcct

SEQ ID NO: 2944 - DNA, 20 bp, Artificial Sequence
  Synthetic
ttctcttcccttcatcctcc

SEQ ID NO: 2945 - DNA, 20 bp, Artificial Sequence
  Synthetic
gatgaagggaagagaatgca

SEQ ID NO: 2946 - DNA, 20 bp, Artificial Sequence
  Synthetic
atgaagggaagagaatgcaa

SEQ ID NO: 2947 - DNA, 20 bp, Artificial Sequence
  Synthetic
gggaagagaatgcaagggaa

SEQ ID NO: 2948 - DNA, 20 bp, Artificial Sequence
  Synthetic
aatgcaagggaaaggagtaa

SEQ ID NO: 2949 - DNA, 20 bp, Artificial Sequence
  Synthetic
gcaagggaaaggagtaaagg

SEQ ID NO: 2950 - DNA, 20 bp, Artificial Sequence
  Synthetic
agggaaaggagtaaaggagg

SEQ ID NO: 2951 - DNA, 20 bp, Artificial Sequence
  Synthetic
gaaaggagtaaaggaggagg

SEQ ID NO: 2952 - DNA, 20 bp, Artificial Sequence
  Synthetic
agtaaaggaggaggaggtag

SEQ ID NO: 2953 - DNA, 20 bp, Artificial Sequence
  Synthetic
tattaattccagcacttgtg

SEQ ID NO: 2954 - DNA, 20 bp, Artificial Sequence
  Synthetic
taattccagcacttgtgagg

SEQ ID NO: 2955 - DNA, 20 bp, Artificial Sequence
  Synthetic
aattccagcacttgtgagga

SEQ ID NO: 2956 - DNA, 20 bp, Artificial Sequence
  Synthetic
attccagcacttgtgaggag

SEQ ID NO: 2957 - DNA, 20 bp, Artificial Sequence
  Synthetic
tgtcccctcctcacaagtgc

SEQ ID NO: 2958 - DNA, 20 bp, Artificial Sequence
  Synthetic
gacagagctctgtgagttca

SEQ ID NO: 2959 - DNA, 20 bp, Artificial Sequence
  Synthetic
tggaactgactatgcagagg

SEQ ID NO: 2960 - DNA, 20 bp, Artificial Sequence
  Synthetic
ctggaactgactatgcagag

SEQ ID NO: 2961 - DNA, 20 bp, Artificial Sequence
  Synthetic
ccctctgcatagtcagttcc

SEQ ID NO: 2962 - DNA, 20 bp, Artificial Sequence
  Synthetic
cctggaactgactatgcaga

SEQ ID NO: 2963 - DNA, 20 bp, Artificial Sequence
  Synthetic
tcctggaactgactatgcag

SEQ ID NO: 2964 - DNA, 20 bp, Artificial Sequence
  Synthetic
gtcagttccaggatagccaa

SEQ ID NO: 2965 - DNA, 20 bp, Artificial Sequence
  Synthetic
tatgtagccattggctatcc

SEQ ID NO: 2966 - DNA, 20 bp, Artificial Sequence
  Synthetic
gggtctcattatgtagccat

SEQ ID NO: 2967 - DNA, 20 bp, Artificial Sequence
  Synthetic
atgagaccctgtgtcagaga

SEQ ID NO: 2968 - DNA, 20 bp, Artificial Sequence
  Synthetic
agaccctgtgtcagagaagg

SEQ ID NO: 2969 - DNA, 20 bp, Artificial Sequence
  Synthetic
cggccaccttctctgacaca

SEQ ID NO: 2970 - DNA, 20 bp, Artificial Sequence
  Synthetic
cctgtgtcagagaaggtggc

SEQ ID NO: 2971 - DNA, 20 bp, Artificial Sequence
  Synthetic
ccggccaccttctctgacac

SEQ ID NO: 2972 - DNA, 20 bp, Artificial Sequence
  Synthetic
gtcagagaaggtggccggcg

SEQ ID NO: 2973 - DNA, 20 bp, Artificial Sequence
  Synthetic
tcagagaaggtggccggcga

SEQ ID NO: 2974 - DNA, 20 bp, Artificial Sequence
  Synthetic
taagcatcaatatccctcgc

SEQ ID NO: 2975 - DNA, 20 bp, Artificial Sequence
  Synthetic
taactcattcagctgtgtgg

SEQ ID NO: 2976 - DNA, 20 bp, Artificial Sequence
  Synthetic
gtttaactcattcagctgtg

SEQ ID NO: 2977 - DNA, 20 bp, Artificial Sequence
  Synthetic
agtgcaaaagtagcaggaac

SEQ ID NO: 2978 - DNA, 20 bp, Artificial Sequence
  Synthetic
attgaaagtgcaaaagtagc

SEQ ID NO: 2979 - DNA, 20 bp, Artificial Sequence
  Synthetic
atgctcccagattacttaca

SEQ ID NO: 2980 - DNA, 20 bp, Artificial Sequence
  Synthetic
aaattccatgtaagtaatct

SEQ ID NO: 2981 - DNA, 20 bp, Artificial Sequence
  Synthetic
taaattccatgtaagtaatc

SEQ ID NO: 2982 - DNA, 20 bp, Artificial Sequence
  Synthetic
atggaatttatattttattg

SEQ ID NO: 2983 - DNA, 20 bp, Artificial Sequence
  Synthetic
gaggtttgtctatgatgtac

SEQ ID NO: 2984 - DNA, 20 bp, Artificial Sequence
  Synthetic
ttggttgaaaatttttcttg

SEQ ID NO: 2985 - DNA, 20 bp, Artificial Sequence
  Synthetic
aaattttcaaccaatagtcc

SEQ ID NO: 2986 - DNA, 20 bp, Artificial Sequence
  Synthetic
gttatttttgcctggactat

SEQ ID NO: 2987 - DNA, 20 bp, Artificial Sequence
  Synthetic
aaaaagaggttatttttgcc

SEQ ID NO: 2988 - DNA, 20 bp, Artificial Sequence
  Synthetic
agaaagaaagaaagaaaaag

SEQ ID NO: 2989 - DNA, 20 bp, Artificial Sequence
  Synthetic
tctttttttttttttttttt

SEQ ID NO: 2990 - DNA, 20 bp, Artificial Sequence
  Synthetic
tttttttggttttttgaaac

SEQ ID NO: 2991 - DNA, 20 bp, Artificial Sequence
  Synthetic
ttttttggttttttgaaaca

SEQ ID NO: 2992 - DNA, 20 bp, Artificial Sequence
  Synthetic
agggtttctctgtatagccc

SEQ ID NO: 2993 - DNA, 20 bp, Artificial Sequence
  Synthetic
ctgtatagccctggctgtcc

SEQ ID NO: 2994 - DNA, 20 bp, Artificial Sequence
  Synthetic
agtgagttccaggacagcca

SEQ ID NO: 2995 - DNA, 20 bp, Artificial Sequence
  Synthetic
aagtgagttccaggacagcc

SEQ ID NO: 2996 - DNA, 20 bp, Artificial Sequence
  Synthetic
tggtgtacaaagtgagttcc

SEQ ID NO: 2997 - DNA, 20 bp, Artificial Sequence
  Synthetic
tggaactcactttgtacacc

SEQ ID NO: 2998 - DNA, 20 bp, Artificial Sequence
  Synthetic
actcactttgtacaccaggc

SEQ ID NO: 2999 - DNA, 20 bp, Artificial Sequence
  Synthetic
ttctgagttcgaggccagcc

SEQ ID NO: 3000 - DNA, 20 bp, Artificial Sequence
  Synthetic
caggtggatttctgagttcg

SEQ ID NO: 3001 - DNA, 20 bp, Artificial Sequence
  Synthetic
actcgggaggcagaggcagg

SEQ ID NO: 3002 - DNA, 20 bp, Artificial Sequence
  Synthetic
agcactcgggaggcagaggc

SEQ ID NO: 3003 - DNA, 20 bp, Artificial Sequence
  Synthetic
gcctctgcctcccgagtgct

SEQ ID NO: 3004 - DNA, 20 bp, Artificial Sequence
  Synthetic
tccgagcactcgggaggcag

SEQ ID NO: 3005 - DNA, 20 bp, Artificial Sequence
  Synthetic
ctttaatccgagcactcggg

SEQ ID NO: 3006 - DNA, 20 bp, Artificial Sequence
  Synthetic
ctcccgagtgctcggattaa

SEQ ID NO: 3007 - DNA, 20 bp, Artificial Sequence
  Synthetic
cgcctttaatccgagcactc

SEQ ID NO: 3008 - DNA, 20 bp, Artificial Sequence
  Synthetic
acgcctttaatccgagcact

SEQ ID NO: 3009 - DNA, 20 bp, Artificial Sequence
  Synthetic
tattttttgcgggacggtgg

SEQ ID NO: 3010 - DNA, 20 bp, Artificial Sequence
  Synthetic
ggttattttttgcgggacgg

SEQ ID NO: 3011 - DNA, 20 bp, Artificial Sequence
  Synthetic
acaggttattttttgcggga

SEQ ID NO: 3012 - DNA, 20 bp, Artificial Sequence
  Synthetic
aaaaacaggttattttttgc

SEQ ID NO: 3013 - DNA, 20 bp, Artificial Sequence
  Synthetic
caaaaacaggttattttttg

SEQ ID NO: 3014 - DNA, 20 bp, Artificial Sequence
  Synthetic
ataattaaaacaacaaaaac

SEQ ID NO: 3015 - DNA, 20 bp, Artificial Sequence
  Synthetic
tttttaagattttatgtgta

SEQ ID NO: 3016 - DNA, 20 bp, Artificial Sequence
  Synthetic
ttttaagattttatgtgtat

SEQ ID NO: 3017 - DNA, 20 bp, Artificial Sequence
  Synthetic
ctgtgtaccacttgtatgct

SEQ ID NO: 3018 - DNA, 20 bp, Artificial Sequence
  Synthetic
ttgggcaccaagcatacaag

SEQ ID NO: 3019 - DNA, 20 bp, Artificial Sequence
  Synthetic
tgtatgcttggtgcccaaga

SEQ ID NO: 3020 - DNA, 20 bp, Artificial Sequence
  Synthetic
tgatctgttctgtccttctt

SEQ ID NO: 3021 - DNA, 20 bp, Artificial Sequence
  Synthetic
atgatctgttctgtccttct

SEQ ID NO: 3022 - DNA, 20 bp, Artificial Sequence
  Synthetic
agaaggacagaacagatcat

SEQ ID NO: 3023 - DNA, 20 bp, Artificial Sequence
  Synthetic
gaaggacagaacagatcata

SEQ ID NO: 3024 - DNA, 20 bp, Artificial Sequence
  Synthetic
gaacagatcatagggtttcc

SEQ ID NO: 3025 - DNA, 20 bp, Artificial Sequence
  Synthetic
aacagatcatagggtttcct

SEQ ID NO: 3026 - DNA, 20 bp, Artificial Sequence
  Synthetic
tttcctgggataagagttat

SEQ ID NO: 3027 - DNA, 20 bp, Artificial Sequence
  Synthetic
actcctataactcttatccc

SEQ ID NO: 3028 - DNA, 20 bp, Artificial Sequence
  Synthetic
gatgactgtaagccaccaag

SEQ ID NO: 3029 - DNA, 20 bp, Artificial Sequence
  Synthetic
gtaagccaccaagtggacgc

SEQ ID NO: 3030 - DNA, 20 bp, Artificial Sequence
  Synthetic
taagccaccaagtggacgct

SEQ ID NO: 3031 - DNA, 20 bp, Artificial Sequence
  Synthetic
aattcccagcgtccacttgg

SEQ ID NO: 3032 - DNA, 20 bp, Artificial Sequence
  Synthetic
ttcaattcccagcgtccact

SEQ ID NO: 3033 - DNA, 20 bp, Artificial Sequence
  Synthetic
ggacgctgggaattgaacct

SEQ ID NO: 3034 - DNA, 20 bp, Artificial Sequence
  Synthetic
ggaattgaaccttggttagc

SEQ ID NO: 3035 - DNA, 20 bp, Artificial Sequence
  Synthetic
gacactcttccagctaacca

SEQ ID NO: 3036 - DNA, 20 bp, Artificial Sequence
  Synthetic
gggactggaattaaaaatac

SEQ ID NO: 3037 - DNA, 20 bp, Artificial Sequence
  Synthetic
catagacaaacaacggggac

SEQ ID NO: 3038 - DNA, 20 bp, Artificial Sequence
  Synthetic
atcttcatagacaaacaacg

SEQ ID NO: 3039 - DNA, 20 bp, Artificial Sequence
  Synthetic
aatcttcatagacaaacaac

SEQ ID NO: 3040 - DNA, 20 bp, Artificial Sequence
  Synthetic
aaatcttcatagacaaacaa

SEQ ID NO: 3041 - DNA, 20 bp, Artificial Sequence
  Synthetic
ttgtctatgaagattttgct

SEQ ID NO: 3042 - DNA, 20 bp, Artificial Sequence
  Synthetic
ttttgcttggtagtccagtc

SEQ ID NO: 3043 - DNA, 20 bp, Artificial Sequence
  Synthetic
ccagtctggctttaagaaac

SEQ ID NO: 3044 - DNA, 20 bp, Artificial Sequence
  Synthetic
cctgtttcttaaagccagac

SEQ ID NO: 3045 - DNA, 20 bp, Artificial Sequence
  Synthetic
cagtctggctttaagaaaca

SEQ ID NO: 3046 - DNA, 20 bp, Artificial Sequence
  Synthetic
aacagggtctcatgcatccc

SEQ ID NO: 3047 - DNA, 20 bp, Artificial Sequence
  Synthetic
atggaagtctgagcaagcca

SEQ ID NO: 3048 - DNA, 20 bp, Artificial Sequence
  Synthetic
catggaagtctgagcaagcc

SEQ ID NO: 3049 - DNA, 20 bp, Artificial Sequence
  Synthetic
ctcagacttccatgcagctg

SEQ ID NO: 3050 - DNA, 20 bp, Artificial Sequence
  Synthetic
gacttccatgcagctgagga

SEQ ID NO: 3051 - DNA, 20 bp, Artificial Sequence
  Synthetic
taaagccatcctcagctgca

SEQ ID NO: 3052 - DNA, 20 bp, Artificial Sequence
  Synthetic
tctacgaggaaaaggcagga

SEQ ID NO: 3053 - DNA, 20 bp, Artificial Sequence
  Synthetic
ctctacgaggaaaaggcagg

SEQ ID NO: 3054 - DNA, 20 bp, Artificial Sequence
  Synthetic
gcactctacgaggaaaaggc

SEQ ID NO: 3055 - DNA, 20 bp, Artificial Sequence
  Synthetic
ctcagcactctacgaggaaa

SEQ ID NO: 3056 - DNA, 20 bp, Artificial Sequence
  Synthetic
tgtaatctcagcactctacg

SEQ ID NO: 3057 - DNA, 20 bp, Artificial Sequence
  Synthetic
gagaagtctgctggtggcac

SEQ ID NO: 3058 - DNA, 20 bp, Artificial Sequence
  Synthetic
tgttaggagaagtctgctgg

SEQ ID NO: 3059 - DNA, 20 bp, Artificial Sequence
  Synthetic
tcttgttaggagaagtctgc

SEQ ID NO: 3060 - DNA, 20 bp, Artificial Sequence
  Synthetic
gacttctcctaacaagaatg

SEQ ID NO: 3061 - DNA, 20 bp, Artificial Sequence
  Synthetic
tcctaacaagaatgtggcac

SEQ ID NO: 3062 - DNA, 20 bp, Artificial Sequence
  Synthetic
cctaacaagaatgtggcaca

SEQ ID NO: 3063 - DNA, 20 bp, Artificial Sequence
  Synthetic
ccctgtgccacattcttgtt

SEQ ID NO: 3064 - DNA, 20 bp, Artificial Sequence
  Synthetic
aacaagaatgtggcacaggg

SEQ ID NO: 3065 - DNA, 20 bp, Artificial Sequence
  Synthetic
atgtggcacagggaggcaac

SEQ ID NO: 3066 - DNA, 20 bp, Artificial Sequence
  Synthetic
tgtggcacagggaggcaact

SEQ ID NO: 3067 - DNA, 20 bp, Artificial Sequence
  Synthetic
gaggcaactgggaatcaaac

SEQ ID NO: 3068 - DNA, 20 bp, Artificial Sequence
  Synthetic
caactgggaatcaaacagga

SEQ ID NO: 3069 - DNA, 20 bp, Artificial Sequence
  Synthetic
ctgggaatcaaacaggaagg

SEQ ID NO: 3070 - DNA, 20 bp, Artificial Sequence
  Synthetic
aaacaggaaggaggagtaaa

SEQ ID NO: 3071 - DNA, 20 bp, Artificial Sequence
  Synthetic
aggaaggaggagtaaaagga

SEQ ID NO: 3072 - DNA, 20 bp, Artificial Sequence
  Synthetic
ggaaggaggagtaaaaggaa

SEQ ID NO: 3073 - DNA, 20 bp, Artificial Sequence
  Synthetic
gaaggaggagtaaaaggaag

SEQ ID NO: 3074 - DNA, 20 bp, Artificial Sequence
  Synthetic
ggaggagtaaaaggaagggg

SEQ ID NO: 3075 - DNA, 20 bp, Artificial Sequence
  Synthetic
gagtaaaaggaaggggagga

SEQ ID NO: 3076 - DNA, 20 bp, Artificial Sequence
  Synthetic
aaaggaaggggaggaaggag

SEQ ID NO: 3077 - DNA, 20 bp, Artificial Sequence
  Synthetic
gggaggaaggagaggagaag

SEQ ID NO: 3078 - DNA, 20 bp, Artificial Sequence
  Synthetic
ggaaggagaggagaagtggc

SEQ ID NO: 3079 - DNA, 20 bp, Artificial Sequence
  Synthetic
aggagaggagaagtggcagg

SEQ ID NO: 3080 - DNA, 20 bp, Artificial Sequence
  Synthetic
gtggcaggaggagaagaaaa

SEQ ID NO: 3081 - DNA, 20 bp, Artificial Sequence
  Synthetic
gcaggaggagaagaaaaagg

SEQ ID NO: 3082 - DNA, 20 bp, Artificial Sequence
  Synthetic
ggaggagaagaaaaaggagg

SEQ ID NO: 3083 - DNA, 20 bp, Artificial Sequence
  Synthetic
agaaaaaggaggcggagaaa

SEQ ID NO: 3084 - DNA, 20 bp, Artificial Sequence
  Synthetic
aaaaggaggcggagaaaagg

SEQ ID NO: 3085 - DNA, 20 bp, Artificial Sequence
  Synthetic
aggcggagaaaaggtggtag

SEQ ID NO: 3086 - DNA, 20 bp, Artificial Sequence
  Synthetic
cggagaaaaggtggtagtgg

SEQ ID NO: 3087 - DNA, 20 bp, Artificial Sequence
  Synthetic
agaaaaggtggtagtggtgg

SEQ ID NO: 3088 - DNA, 20 bp, Artificial Sequence
  Synthetic
ggtggtagtggtggaggaag

SEQ ID NO: 3089 - DNA, 20 bp, Artificial Sequence
  Synthetic
ggtagtggtggaggaagagg

SEQ ID NO: 3090 - DNA, 20 bp, Artificial Sequence
  Synthetic
agtggtggaggaagaggagg

SEQ ID NO: 3091 - DNA, 20 bp, Artificial Sequence
  Synthetic
ggtggaggaagaggaggagg

SEQ ID NO: 3092 - DNA, 20 bp, Artificial Sequence
  Synthetic
ggaggaagaggaggaggagg

SEQ ID NO: 3093 - DNA, 20 bp, Artificial Sequence
  Synthetic
ggaagaggaggaggaggagg

SEQ ID NO: 3094 - DNA, 20 bp, Artificial Sequence
  Synthetic
agaggaggaggaggaggagg

SEQ ID NO: 3095 - DNA, 20 bp, Artificial Sequence
  Synthetic
ggaggaggaggaggaggagg

SEQ ID NO: 3096 - DNA, 20 bp, Artificial Sequence
  Synthetic
ggaggaggaggaggaggagg

SEQ ID NO: 3097 - DNA, 20 bp, Artificial Sequence
  Synthetic
gaggaggaggaggaggagga

SEQ ID NO: 3098 - DNA, 20 bp, Artificial Sequence
  Synthetic
aggaggaggaggaggaggag

SEQ ID NO: 3099 - DNA, 20 bp, Artificial Sequence
  Synthetic
ggaggaggaggaggaggagg

SEQ ID NO: 3100 - DNA, 20 bp, Artificial Sequence
  Synthetic
gagggggacttaatcagtaa

SEQ ID NO: 3101 - DNA, 20 bp, Artificial Sequence
  Synthetic
acttaatcagtaaaggaaaa

SEQ ID NO: 3102 - DNA, 20 bp, Artificial Sequence
  Synthetic
aaaaggctgagctcagtcct

SEQ ID NO: 3103 - DNA, 20 bp, Artificial Sequence
  Synthetic
ctcagtccttggaacctaca

SEQ ID NO: 3104 - DNA, 20 bp, Artificial Sequence
  Synthetic
gtccttggaacctacatggt

SEQ ID NO: 3105 - DNA, 20 bp, Artificial Sequence
  Synthetic
ctcctaccatgtaggttcca

SEQ ID NO: 3106 - DNA, 20 bp, Artificial Sequence
  Synthetic
ctcattctctcctaccatgt

SEQ ID NO: 3107 - DNA, 20 bp, Artificial Sequence
  Synthetic
gtttcctctgatccccacac

SEQ ID NO: 3108 - DNA, 20 bp, Artificial Sequence
  Synthetic
tgctccagtgtggggatcag

SEQ ID NO: 3109 - DNA, 20 bp, Artificial Sequence
  Synthetic
tgatccccacactggagcaa

SEQ ID NO: 3110 - DNA, 20 bp, Artificial Sequence
  Synthetic
ggcaccattgctccagtgtg

SEQ ID NO: 3111 - DNA, 20 bp, Artificial Sequence
  Synthetic
tggcaccattgctccagtgt

SEQ ID NO: 3112 - DNA, 20 bp, Artificial Sequence
  Synthetic
atggcaccattgctccagtg

SEQ ID NO: 3113 - DNA, 20 bp, Artificial Sequence
  Synthetic
gaagtgggagagtgatgtga

SEQ ID NO: 3114 - DNA, 20 bp, Artificial Sequence
  Synthetic
tgtgaggagttgggtgaagt

SEQ ID NO: 3115 - DNA, 20 bp, Artificial Sequence
  Synthetic
ttgtgaggagttgggtgaag

SEQ ID NO: 3116 - DNA, 20 bp, Artificial Sequence
  Synthetic
ttttatttttgtgaggagtt

SEQ ID NO: 3117 - DNA, 20 bp, Artificial Sequence
  Synthetic
tttttatttttgtgaggagt

SEQ ID NO: 3118 - DNA, 20 bp, Artificial Sequence
  Synthetic
ttttgttttttatttttgtg

SEQ ID NO: 3119 - DNA, 20 bp, Artificial Sequence
  Synthetic
ttaaaaaagaaagctgtagc

SEQ ID NO: 3120 - DNA, 20 bp, Artificial Sequence
  Synthetic
taaaaaagaaagctgtagcc

SEQ ID NO: 3121 - DNA, 20 bp, Artificial Sequence
  Synthetic
aagaaagctgtagccgggcg

SEQ ID NO: 3122 - DNA, 20 bp, Artificial Sequence
  Synthetic
aaagctgtagccgggcgtgg

SEQ ID NO: 3123 - DNA, 20 bp, Artificial Sequence
  Synthetic
aaagtgtgtgccaccacgcc

SEQ ID NO: 3124 - DNA, 20 bp, Artificial Sequence
  Synthetic
gtggcacacacttttaatcc

SEQ ID NO: 3125 - DNA, 20 bp, Artificial Sequence
  Synthetic
acacttttaatcccggcact

SEQ ID NO: 3126 - DNA, 20 bp, Artificial Sequence
  Synthetic
cacttttaatcccggcactt

SEQ ID NO: 3127 - DNA, 20 bp, Artificial Sequence
  Synthetic
ttttaatcccggcacttggg

SEQ ID NO: 3128 - DNA, 20 bp, Artificial Sequence
  Synthetic
tcccggcacttgggaggcag

SEQ ID NO: 3129 - DNA, 20 bp, Artificial Sequence
  Synthetic
gcctctgcctcccaagtgcc

SEQ ID NO: 3130 - DNA, 20 bp, Artificial Sequence
  Synthetic
tgcctctgcctcccaagtgc

SEQ ID NO: 3131 - DNA, 20 bp, Artificial Sequence
  Synthetic
acttgggaggcagaggcaag

SEQ ID NO: 3132 - DNA, 20 bp, Artificial Sequence
  Synthetic
caagcggatttctgagttcg

SEQ ID NO: 3133 - DNA, 20 bp, Artificial Sequence
  Synthetic
ttctgagttcgaggccagct

SEQ ID NO: 3134 - DNA, 20 bp, Artificial Sequence
  Synthetic
actcactttgtagaccaagc

SEQ ID NO: 3135 - DNA, 20 bp, Artificial Sequence
  Synthetic
tggtctacaaagtgagttcc

SEQ ID NO: 3136 - DNA, 20 bp, Artificial Sequence
  Synthetic
aagtgagttccaggacagcc

SEQ ID NO: 3137 - DNA, 20 bp, Artificial Sequence
  Synthetic
agtgagttccaggacagcca

SEQ ID NO: 3138 - DNA, 20 bp, Artificial Sequence
  Synthetic
ctgtgtagccctggctgtcc

SEQ ID NO: 3139 - DNA, 20 bp, Artificial Sequence
  Synthetic
agggtttctctgtgtagccc

SEQ ID NO: 3140 - DNA, 20 bp, Artificial Sequence
  Synthetic
tcttttggtttttcaagaca

SEQ ID NO: 3141 - DNA, 20 bp, Artificial Sequence
  Synthetic
ttcttttggtttttcaagac

SEQ ID NO: 3142 - DNA, 20 bp, Artificial Sequence
  Synthetic
acagctttctttttttcttt

SEQ ID NO: 3143 - DNA, 20 bp, Artificial Sequence
  Synthetic
tatattaatatagcaaagca

SEQ ID NO: 3144 - DNA, 20 bp, Artificial Sequence
  Synthetic
atatattaatatagcaaagc

SEQ ID NO: 3145 - DNA, 20 bp, Artificial Sequence
  Synthetic
tgttttttcttatagaatta

SEQ ID NO: 3146 - DNA, 20 bp, Artificial Sequence
  Synthetic
ttctggagggaggaaaagga

SEQ ID NO: 3147 - DNA, 20 bp, Artificial Sequence
  Synthetic
ctcattctggagggaggaaa

SEQ ID NO: 3148 - RNA, 20 nt, Artificial Sequence
  Synthetic
gggccuuaugcaucuccauc

SEQ ID NO: 3149 - RNA, 20 nt, Artificial Sequence
  Synthetic
uaaucagcauauuauccaga

SEQ ID NO: 3150 - RNA, 20 nt, Artificial Sequence
  Synthetic
cccuuuuguacguuuuuuaa

SEQ ID NO: 3151 - RNA, 20 nt, Artificial Sequence
  Synthetic
cuguaucuucuuagccagua

SEQ ID NO: 3152 - RNA, 20 nt, Artificial Sequence
  Synthetic
guuaacgcgucauuuacauu

SEQ ID NO: 3153 - RNA, 20 nt, Artificial Sequence
  Synthetic
uacaauaaauuagccggaug

SEQ ID NO: 3154 - RNA, 20 nt, Artificial Sequence
  Synthetic
aaacuuuuaggagucaaagu

SEQ ID NO: 3155 - RNA, 20 nt, Artificial Sequence
  Synthetic
aaaacuuuuaggagucaaag

SEQ ID NO: 3156 - RNA, 20 nt, Artificial Sequence
  Synthetic
aauguuaacaguguuggcuu

SEQ ID NO: 3157 - RNA, 20 nt, Artificial Sequence
  Synthetic
gugguggcugcaggugaggg

SEQ ID NO: 3158 - RNA, 20 nt, Artificial Sequence
  Synthetic
uacuaaaauguuaacagugu

SEQ ID NO: 3159 - RNA, 20 nt, Artificial Sequence
  Synthetic
aaaaaaggacuugacaugca

SEQ ID NO: 3160 - RNA, 20 nt, Artificial Sequence
  Synthetic
gucccagcuucucuugaggg

SEQ ID NO: 3161 - RNA, 20 nt, Artificial Sequence
  Synthetic
guuaacaguguuggcuuugg

SEQ ID NO: 3162 - RNA, 20 nt, Artificial Sequence
  Synthetic
guugguggucacugacagug

SEQ ID NO: 3163 - RNA, 20 nt, Artificial Sequence
  Synthetic
gaaacuaguggcuaccguac

SEQ ID NO: 3164 - RNA, 20 nt, Artificial Sequence
  Synthetic
aaaaaacguacaaaaggggc

SEQ ID NO: 3165 - RNA, 20 nt, Artificial Sequence
  Synthetic
agccccaggccaucaaccgg

SEQ ID NO: 3166 - RNA, 20 nt, Artificial Sequence
  Synthetic
ggcagccagacagaugcuuc

SEQ ID NO: 3167 - RNA, 20 nt, Artificial Sequence
  Synthetic
cuggagaacaaaagcauuuu

SEQ ID NO: 3168 - RNA, 20 nt, Artificial Sequence
  Synthetic
aucuuagauuuaugcaaugu

SEQ ID NO: 3169 - RNA, 20 nt, Artificial Sequence
  Synthetic
acaaguagaaucagaauucu

SEQ ID NO: 3170 - RNA, 20 nt, Artificial Sequence
  Synthetic
aauaucggcucacugcaacc

SEQ ID NO: 3171 - RNA, 20 nt, Artificial Sequence
  Synthetic
cccucaagagaagcugggac

SEQ ID NO: 3172 - RNA, 20 nt, Artificial Sequence
  Synthetic
ucuuaggagaugacgagguu

SEQ ID NO: 3173 - RNA, 20 nt, Artificial Sequence
  Synthetic
aauaauaaagaacuagagaa

SEQ ID NO: 3174 - RNA, 20 nt, Artificial Sequence
  Synthetic
aaaaacguacaaaaggggcc

SEQ ID NO: 3175 - RNA, 20 nt, Artificial Sequence
  Synthetic
ggcugagcaggcggagaagu

SEQ ID NO: 3176 - RNA, 20 nt, Artificial Sequence
  Synthetic
agagaaaggagaacagucug

SEQ ID NO: 3177 - RNA, 20 nt, Artificial Sequence
  Synthetic
cuucuuucucuuucacgaga

SEQ ID NO: 3178 - RNA, 20 nt, Artificial Sequence
  Synthetic
aaucuuagauuuaugcaaug

SEQ ID NO: 3179 - RNA, 20 nt, Artificial Sequence
  Synthetic
cugagcaggcggagaaguag

SEQ ID NO: 3180 - RNA, 20 nt, Artificial Sequence
  Synthetic
accuaguguugacaaggcug

SEQ ID NO: 3181 - RNA, 20 nt, Artificial Sequence
  Synthetic
ucccagcuucucuugagggu

SEQ ID NO: 3182 - RNA, 20 nt, Artificial Sequence
  Synthetic
aauaauucuguugggacgac

SEQ ID NO: 3183 - RNA, 20 nt, Artificial Sequence
  Synthetic
ccuauaaagaggacguuucc

SEQ ID NO: 3184 - RNA, 20 nt, Artificial Sequence
  Synthetic
ccuucuuucucuuucacgag

SEQ ID NO: 3185 - RNA, 20 nt, Artificial Sequence
  Synthetic
cccaucgaaguacucaccau

SEQ ID NO: 3186 - RNA, 20 nt, Artificial Sequence
  Synthetic
gugucauauguugcuggugg

SEQ ID NO: 3187 - RNA, 20 nt, Artificial Sequence
  Synthetic
aauguaaaugacgcguuaac

SEQ ID NO: 3188 - RNA, 20 nt, Artificial Sequence
  Synthetic
gccuuugagccaaguggauu

SEQ ID NO: 3189 - RNA, 20 nt, Artificial Sequence
  Synthetic
gucagacucugugcuggcug

SEQ ID NO: 3190 - RNA, 20 nt, Artificial Sequence
  Synthetic
ccgucaauagcauuccgguu

SEQ ID NO: 3191 - RNA, 20 nt, Artificial Sequence
  Synthetic
ccauuaaaaaacguacaaaa

SEQ ID NO: 3192 - RNA, 20 nt, Artificial Sequence
  Synthetic
gggauuuggggaggaugggg

SEQ ID NO: 3193 - RNA, 20 nt, Artificial Sequence
  Synthetic
acugugucauauguugcugg

SEQ ID NO: 3194 - RNA, 20 nt, Artificial Sequence
  Synthetic
uacaauguuguggaccgggc

SEQ ID NO: 3195 - RNA, 20 nt, Artificial Sequence
  Synthetic
gauagaguagcaaacaaaac

SEQ ID NO: 3196 - RNA, 20 nt, Artificial Sequence
  Synthetic
gcucucaaaggagacugaga

SEQ ID NO: 3197 - RNA, 20 nt, Artificial Sequence
  Synthetic
ggaagagcaaggagcuccug

SEQ ID NO: 3198 - RNA, 20 nt, Artificial Sequence
  Synthetic
ugugucauauguugcuggug

SEQ ID NO: 3199 - RNA, 20 nt, Artificial Sequence
  Synthetic
cugagaagguguaccuagag

SEQ ID NO: 3200 - RNA, 20 nt, Artificial Sequence
  Synthetic
guccgggagccaguuccugc

SEQ ID NO: 3201 - RNA, 20 nt, Artificial Sequence
  Synthetic
uuaggagaugacgagguugg

SEQ ID NO: 3202 - RNA, 20 nt, Artificial Sequence
  Synthetic
ggaggaagcagagcucucaa

SEQ ID NO: 3203 - RNA, 20 nt, Artificial Sequence
  Synthetic
agucaucagccugggaaaca

SEQ ID NO: 3204 - RNA, 20 nt, Artificial Sequence
  Synthetic
uccgggagccaguuccugca

SEQ ID NO: 3205 - RNA, 20 nt, Artificial Sequence
  Synthetic
gagcaaggagcuccugaggc

SEQ ID NO: 3206 - RNA, 20 nt, Artificial Sequence
  Synthetic
ucugguacaauguuguggac

SEQ ID NO: 3207 - RNA, 20 nt, Artificial Sequence
  Synthetic
ccugggagugucugacaacc

SEQ ID NO: 3208 - RNA, 20 nt, Artificial Sequence
  Synthetic
ccaguuccugcagggccucg

SEQ ID NO: 3209 - RNA, 20 nt, Artificial Sequence
  Synthetic
uagggaaugggcugagcagg

SEQ ID NO: 3210 - RNA, 20 nt, Artificial Sequence
  Synthetic
agcuuucugucccugugaga

SEQ ID NO: 3211 - RNA, 20 nt, Artificial Sequence
  Synthetic
ucgucucccugccuucucac

SEQ ID NO: 3212 - RNA, 20 nt, Artificial Sequence
  Synthetic
cgaaguacucaccaugggca

SEQ ID NO: 3213 - RNA, 20 nt, Artificial Sequence
  Synthetic
aggccacuggaccaugccca

SEQ ID NO: 3214 - RNA, 20 nt, Artificial Sequence
  Synthetic
ggcagggagacgagucuaau

SEQ ID NO: 3215 - RNA, 20 nt, Artificial Sequence
  Synthetic
gggcuuagauuuaugcaaua

SEQ ID NO: 3216 - RNA, 20 nt, Artificial Sequence
  Synthetic
uucagcgaagacaagggauu

SEQ ID NO: 3217 - RNA, 20 nt, Artificial Sequence
  Synthetic
cauggcccacgaggcccugc

SEQ ID NO: 3218 - RNA, 20 nt, Artificial Sequence
  Synthetic
caguuccugcagggccucgu

SEQ ID NO: 3219 - RNA, 20 nt, Artificial Sequence
  Synthetic
cauuaaaaaacguacaaaag

SEQ ID NO: 3220 - RNA, 20 nt, Artificial Sequence
  Synthetic
aggcagggagacgagucuaa

SEQ ID NO: 3221 - RNA, 20 nt, Artificial Sequence
  Synthetic
cuaacaucuggaugaaccug

SEQ ID NO: 3222 - RNA, 20 nt, Artificial Sequence
  Synthetic
ccaguggccugucuucuccu

SEQ ID NO: 3223 - RNA, 20 nt, Artificial Sequence
  Synthetic
uauuacaaauacugccgcua

SEQ ID NO: 3224 - RNA, 20 nt, Artificial Sequence
  Synthetic
gcagggagacgagucuaaug

SEQ ID NO: 3225 - RNA, 20 nt, Artificial Sequence
  Synthetic
caaucugcuugagaaacagg

SEQ ID NO: 3226 - RNA, 20 nt, Artificial Sequence
  Synthetic
ggcuuagauuuaugcaauau

SEQ ID NO: 3227 - RNA, 20 nt, Artificial Sequence
  Synthetic
acacucccagggcucacucu

SEQ ID NO: 3228 - RNA, 20 nt, Artificial Sequence
  Synthetic
uaugggcucauucugccccu

SEQ ID NO: 3229 - RNA, 20 nt, Artificial Sequence
  Synthetic
cgaagacaagggauuugggg

SEQ ID NO: 3230 - RNA, 20 nt, Artificial Sequence
  Synthetic
agcacagagucugacauuga

SEQ ID NO: 3231 - RNA, 20 nt, Artificial Sequence
  Synthetic
gucuuaggagaugacgaggu

SEQ ID NO: 3232 - RNA, 20 nt, Artificial Sequence
  Synthetic
gcugagcaggcggagaagua

SEQ ID NO: 3233 - RNA, 20 nt, Artificial Sequence
  Synthetic
uuccaaucugcuugagaaac

SEQ ID NO: 3234 - RNA, 20 nt, Artificial Sequence
  Synthetic
gagaucauaauacaucucag

SEQ ID NO: 3235 - RNA, 20 nt, Artificial Sequence
  Synthetic
gcccaucgaaguacucacca

SEQ ID NO: 3236 - RNA, 20 nt, Artificial Sequence
  Synthetic
caggcggagaaguaggggug

SEQ ID NO: 3237 - RNA, 20 nt, Artificial Sequence
  Synthetic
uugaaacccagucaccaaug

SEQ ID NO: 3238 - RNA, 20 nt, Artificial Sequence
  Synthetic
acauaauccaacugagaguc

SEQ ID NO: 3239 - RNA, 20 nt, Artificial Sequence
  Synthetic
gugaguguacugagucuccg

SEQ ID NO: 3240 - RNA, 20 nt, Artificial Sequence
  Synthetic
caauggagucacacagcaug

SEQ ID NO: 3241 - RNA, 20 nt, Artificial Sequence
  Synthetic
gggguggggggacgcauuug

SEQ ID NO: 3242 - RNA, 20 nt, Artificial Sequence
  Synthetic
aacugagagucaggaaaccu

SEQ ID NO: 3243 - RNA, 20 nt, Artificial Sequence
  Synthetic
ugcucacuuccauaaggaua

SEQ ID NO: 3244 - RNA, 20 nt, Artificial Sequence
  Synthetic
auuuggggaggauggggagg

SEQ ID NO: 3245 - RNA, 20 nt, Artificial Sequence
  Synthetic
cgggcuggccacggcaagug

SEQ ID NO: 3246 - RNA, 20 nt, Artificial Sequence
  Synthetic
cucaaugucagacucugugc

SEQ ID NO: 3247 - RNA, 20 nt, Artificial Sequence
  Synthetic
ugcagacuauuaauugcaag

SEQ ID NO: 3248 - RNA, 20 nt, Artificial Sequence
  Synthetic
acaggcgugagccacgggcc

SEQ ID NO: 3249 - RNA, 20 nt, Artificial Sequence
  Synthetic
caucaauugugccaggcccg

SEQ ID NO: 3250 - RNA, 20 nt, Artificial Sequence
  Synthetic
cagcacagagucugacauug

SEQ ID NO: 3251 - RNA, 20 nt, Artificial Sequence
  Synthetic
guugcagacuauuaauugca

SEQ ID NO: 3252 - RNA, 20 nt, Artificial Sequence
  Synthetic
gcaaguguggcaacaggguc

SEQ ID NO: 3253 - RNA, 20 nt, Artificial Sequence
  Synthetic
uagggucuuggaguuuugau

SEQ ID NO: 3254 - RNA, 20 nt, Artificial Sequence
  Synthetic
aaagccucacauggcccacg

SEQ ID NO: 3255 - RNA, 20 nt, Artificial Sequence
  Synthetic
ccucgaggugagcgugugcu

SEQ ID NO: 3256 - RNA, 20 nt, Artificial Sequence
  Synthetic
gcaggcggagaaguaggggu

SEQ ID NO: 3257 - RNA, 20 nt, Artificial Sequence
  Synthetic
cauuuuuguggacaguugug

SEQ ID NO: 3258 - RNA, 20 nt, Artificial Sequence
  Synthetic
uugcagacuauuaauugcaa

SEQ ID NO: 3259 - RNA, 20 nt, Artificial Sequence
  Synthetic
cugguugucagacacuccca

SEQ ID NO: 3260 - RNA, 20 nt, Artificial Sequence
  Synthetic
cagcgaagacaagggauuug

SEQ ID NO: 3261 - RNA, 20 nt, Artificial Sequence
  Synthetic
ucagcgaagacaagggauuu

SEQ ID NO: 3262 - RNA, 20 nt, Artificial Sequence
  Synthetic
uggauuugaaaauaagaagu

SEQ ID NO: 3263 - RNA, 20 nt, Artificial Sequence
  Synthetic
agguuuaaaaauauugggug

SEQ ID NO: 3264 - RNA, 20 nt, Artificial Sequence
  Synthetic
uuggcccagggugguggcag

SEQ ID NO: 3265 - RNA, 20 nt, Artificial Sequence
  Synthetic
acagaaaaagcugucaccaa

SEQ ID NO: 3266 - RNA, 20 nt, Artificial Sequence
  Synthetic
acaagggauuuggggaggau

SEQ ID NO: 3267 - RNA, 20 nt, Artificial Sequence
  Synthetic
ggcagccccaggccaucaac

SEQ ID NO: 3268 - RNA, 20 nt, Artificial Sequence
  Synthetic
cagguucccagcuguacaau

SEQ ID NO: 3269 - RNA, 20 nt, Artificial Sequence
  Synthetic
aggcggagaaguaggggugg

SEQ ID NO: 3270 - RNA, 20 nt, Artificial Sequence
  Synthetic
agugugguggcugcagguga

SEQ ID NO: 3271 - RNA, 20 nt, Artificial Sequence
  Synthetic
agcacauugggcagacacaa

SEQ ID NO: 3272 - RNA, 20 nt, Artificial Sequence
  Synthetic
ccacgaggcccugcaggaac

SEQ ID NO: 3273 - RNA, 20 nt, Artificial Sequence
  Synthetic
cgucucccugccuucucaca

SEQ ID NO: 3274 - RNA, 20 nt, Artificial Sequence
  Synthetic
agauacuaaucccauguaug

SEQ ID NO: 3275 - RNA, 20 nt, Artificial Sequence
  Synthetic
uuaggcuuugcccucauaca

SEQ ID NO: 3276 - RNA, 20 nt, Artificial Sequence
  Synthetic
cuacucgggggaggcugaag

SEQ ID NO: 3277 - RNA, 20 nt, Artificial Sequence
  Synthetic
accucacugccucagcagcg

SEQ ID NO: 3278 - RNA, 20 nt, Artificial Sequence
  Synthetic
uugaggacccaggagaagac

SEQ ID NO: 3279 - RNA, 20 nt, Artificial Sequence
  Synthetic
cuuaggagaugacgagguug

SEQ ID NO: 3280 - RNA, 20 nt, Artificial Sequence
  Synthetic
ggcggagaaguagggguggg

SEQ ID NO: 3281 - RNA, 20 nt, Artificial Sequence
  Synthetic
cugguacaauguuguggacc

SEQ ID NO: 3282 - RNA, 20 nt, Artificial Sequence
  Synthetic
ggcaaagcauucugggcaga

SEQ ID NO: 3283 - RNA, 20 nt, Artificial Sequence
  Synthetic
gaaaauuacggugacugcug

SEQ ID NO: 3284 - RNA, 20 nt, Artificial Sequence
  Synthetic
ggaccaaccuaguguugaca

SEQ ID NO: 3285 - RNA, 20 nt, Artificial Sequence
  Synthetic
gcuuuuguucuccaguuugu

SEQ ID NO: 3286 - RNA, 20 nt, Artificial Sequence
  Synthetic
ugauuuaaucaccaacaaac

SEQ ID NO: 3287 - RNA, 20 nt, Artificial Sequence
  Synthetic
auuuagcaauguuuacuggg

SEQ ID NO: 3288 - RNA, 20 nt, Artificial Sequence
  Synthetic
ggcauugaauccaauaugug

SEQ ID NO: 3289 - RNA, 20 nt, Artificial Sequence
  Synthetic
guguuaccaucagagauugc

SEQ ID NO: 3290 - RNA, 20 nt, Artificial Sequence
  Synthetic
guaggccauucagugcuuac

SEQ ID NO: 3291 - RNA, 20 nt, Artificial Sequence
  Synthetic
uuugaaaauaagaaguuggc

SEQ ID NO: 3292 - RNA, 20 nt, Artificial Sequence
  Synthetic
caccucguuccgccgguuga

SEQ ID NO: 3293 - RNA, 20 nt, Artificial Sequence
  Synthetic
acacgcucaccucgagggcu

SEQ ID NO: 3294 - RNA, 20 nt, Artificial Sequence
  Synthetic
gauauccaguaagcacugaa

SEQ ID NO: 3295 - RNA, 20 nt, Artificial Sequence
  Synthetic
uggauuuagcaauguuuacu

SEQ ID NO: 3296 - RNA, 20 nt, Artificial Sequence
  Synthetic
uaaagaggacguuuccuggc

SEQ ID NO: 3297 - RNA, 20 nt, Artificial Sequence
  Synthetic
uuaaucugucuuuugucgua

SEQ ID NO: 3298 - RNA, 20 nt, Artificial Sequence
  Synthetic
auaggaaaugccuuacugug

SEQ ID NO: 3299 - RNA, 20 nt, Artificial Sequence
  Synthetic
cuuacuggauaucugaaccu

SEQ ID NO: 3300 - RNA, 20 nt, Artificial Sequence
  Synthetic
aguaaacauugcuaaaucca

SEQ ID NO: 3301 - RNA, 20 nt, Artificial Sequence
  Synthetic
ggguucuugccuugggguau

SEQ ID NO: 3302 - RNA, 20 nt, Artificial Sequence
  Synthetic
gugaggcuuuguggaacuug

SEQ ID NO: 3303 - RNA, 20 nt, Artificial Sequence
  Synthetic
acaucuuacuacuaccacau

SEQ ID NO: 3304 - RNA, 20 nt, Artificial Sequence
  Synthetic
ccaccaacaccccuugccuu

SEQ ID NO: 3305 - RNA, 20 nt, Artificial Sequence
  Synthetic
uuuuugggagaccaaaggca

SEQ ID NO: 3306 - RNA, 20 nt, Artificial Sequence
  Synthetic
uuucauccuccacgcugcug

SEQ ID NO: 3307 - RNA, 20 nt, Artificial Sequence
  Synthetic
ucagagccacaugaaacuag

SEQ ID NO: 3308 - RNA, 20 nt, Artificial Sequence
  Synthetic
uccauuaaaaaacguacaaa

SEQ ID NO: 3309 - RNA, 20 nt, Artificial Sequence
  Synthetic
aaaaaaaggacuugacaugc

SEQ ID NO: 3310 - RNA, 20 nt, Artificial Sequence
  Synthetic
gcuccugaggcuggagcuag

SEQ ID NO: 3311 - RNA, 20 nt, Artificial Sequence
  Synthetic
agaagguguaccuagagugg

SEQ ID NO: 3312 - RNA, 20 nt, Artificial Sequence
  Synthetic
ggugccagcagauuuggguc

SEQ ID NO: 3313 - RNA, 20 nt, Artificial Sequence
  Synthetic
gauacuaaucccauguauga

SEQ ID NO: 3314 - RNA, 20 nt, Artificial Sequence
  Synthetic
gaaauccgagagugagcccu

SEQ ID NO: 3315 - RNA, 20 nt, Artificial Sequence
  Synthetic
aaaaccccugcaaucucuga

SEQ ID NO: 3316 - RNA, 20 nt, Artificial Sequence
  Synthetic
uaauaauauuuauauuauuc

SEQ ID NO: 3317 - RNA, 20 nt, Artificial Sequence
  Synthetic
agaaaagaaaugcaagaaau

SEQ ID NO: 3318 - RNA, 20 nt, Artificial Sequence
  Synthetic
ugaacugugucauauguugc

SEQ ID NO: 3319 - RNA, 20 nt, Artificial Sequence
  Synthetic
cagaaagcuuucuguaucuc

SEQ ID NO: 3320 - RNA, 20 nt, Artificial Sequence
  Synthetic
agaagcugggacuggcugug

SEQ ID NO: 3321 - RNA, 20 nt, Artificial Sequence
  Synthetic
cuucucuugaggguggggau

SEQ ID NO: 3322 - RNA, 20 nt, Artificial Sequence
  Synthetic
gcccagaaugcuuugcccac

SEQ ID NO: 3323 - RNA, 20 nt, Artificial Sequence
  Synthetic
agcaggcggagaaguagggg

SEQ ID NO: 3324 - RNA, 20 nt, Artificial Sequence
  Synthetic
ucuccucuagcuccagccuc

SEQ ID NO: 3325 - RNA, 20 nt, Artificial Sequence
  Synthetic
gguuaaaugaaagggaaagc

SEQ ID NO: 3326 - RNA, 20 nt, Artificial Sequence
  Synthetic
cuaaagcgcgccuuuccuca

SEQ ID NO: 3327 - RNA, 20 nt, Artificial Sequence
  Synthetic
agaagaugcuggcuuggccc

SEQ ID NO: 3328 - RNA, 20 nt, Artificial Sequence
  Synthetic
caggagcuccuugcucuucc

SEQ ID NO: 3329 - RNA, 20 nt, Artificial Sequence
  Synthetic
cugugucauauguugcuggu

SEQ ID NO: 3330 - RNA, 20 nt, Artificial Sequence
  Synthetic
uagcacauugggcagacaca

SEQ ID NO: 3331 - RNA, 20 nt, Artificial Sequence
  Synthetic
gaagcauaucacuucugcua

SEQ ID NO: 3332 - RNA, 20 nt, Artificial Sequence
  Synthetic
guuguggaccgggcuggcca

SEQ ID NO: 3333 - RNA, 20 nt, Artificial Sequence
  Synthetic
uccaguggccugucuucucc

SEQ ID NO: 3334 - RNA, 20 nt, Artificial Sequence
  Synthetic
aauuuccugcugugacaaca

SEQ ID NO: 3335 - RNA, 20 nt, Artificial Sequence
  Synthetic
caagggauuuggggaggaug

SEQ ID NO: 3336 - RNA, 20 nt, Artificial Sequence
  Synthetic
aggaaguagggaacagggac

SEQ ID NO: 3337 - RNA, 20 nt, Artificial Sequence
  Synthetic
accuccaucucuauaaaaau

SEQ ID NO: 3338 - RNA, 20 nt, Artificial Sequence
  Synthetic
uuacuucucuuuggcuauga

SEQ ID NO: 3339 - RNA, 20 nt, Artificial Sequence
  Synthetic
ucccacuggcccacguugca

SEQ ID NO: 3340 - RNA, 20 nt, Artificial Sequence
  Synthetic
cagccauguugcuucuccuu

SEQ ID NO: 3341 - RNA, 20 nt, Artificial Sequence
  Synthetic
uauuuuucucccuguuuaga

SEQ ID NO: 3342 - RNA, 20 nt, Artificial Sequence
  Synthetic
gggcaaagcauucugggcag

SEQ ID NO: 3343 - RNA, 20 nt, Artificial Sequence
  Synthetic
gaaggaggcgagacaccugu

SEQ ID NO: 3344 - RNA, 20 nt, Artificial Sequence
  Synthetic
auuuccugcugugacaacaa

SEQ ID NO: 3345 - RNA, 20 nt, Artificial Sequence
  Synthetic
aagaaaagaaaugcaagaaa

SEQ ID NO: 3346 - RNA, 20 nt, Artificial Sequence
  Synthetic
gcuucucuugagggugggga

SEQ ID NO: 3347 - RNA, 20 nt, Artificial Sequence
  Synthetic
auuaaucugucuuuugucgu

SEQ ID NO: 3348 - RNA, 20 nt, Artificial Sequence
  Synthetic
acaggaggaacgcacgcagc

SEQ ID NO: 3349 - RNA, 20 nt, Artificial Sequence
  Synthetic
ccugguugucagacacuccc

SEQ ID NO: 3350 - RNA, 20 nt, Artificial Sequence
  Synthetic
aggucaacaucaauugugcc

SEQ ID NO: 3351 - RNA, 20 nt, Artificial Sequence
  Synthetic
gacaagggauuuggggagga

SEQ ID NO: 3352 - RNA, 20 nt, Artificial Sequence
  Synthetic
ggcuuagaucuaaauacucc

SEQ ID NO: 3353 - RNA, 20 nt, Artificial Sequence
  Synthetic
gagcacacagccucacagua

SEQ ID NO: 3354 - RNA, 20 nt, Artificial Sequence
  Synthetic
guuaccaucagagauugcag

SEQ ID NO: 3355 - RNA, 20 nt, Artificial Sequence
  Synthetic
uuggauuuagcaauguuuac

SEQ ID NO: 3356 - RNA, 20 nt, Artificial Sequence
  Synthetic
cuuggaguuuugauaggcac

SEQ ID NO: 3357 - RNA, 20 nt, Artificial Sequence
  Synthetic
auuuaauaaaagagaaaccu

SEQ ID NO: 3358 - RNA, 20 nt, Artificial Sequence
  Synthetic
uuuaauaaaagagaaaccuu

SEQ ID NO: 3359 - RNA, 20 nt, Artificial Sequence
  Synthetic
auuaaaaagcagggagaagg

SEQ ID NO: 3360 - RNA, 20 nt, Artificial Sequence
  Synthetic
gaguuccagaagcaucuguc

SEQ ID NO: 3361 - RNA, 20 nt, Artificial Sequence
  Synthetic
gaagaugcuggcuuggccca

SEQ ID NO: 3362 - RNA, 20 nt, Artificial Sequence
  Synthetic
gcuagaggagagagagucuu

SEQ ID NO: 3363 - RNA, 20 nt, Artificial Sequence
  Synthetic
cgaaggaggcgagacaccug

SEQ ID NO: 3364 - RNA, 20 nt, Artificial Sequence
  Synthetic
gacaaacagccuuugucuuc

SEQ ID NO: 3365 - RNA, 20 nt, Artificial Sequence
  Synthetic
uauuggauucaaugccaaua

SEQ ID NO: 3366 - RNA, 20 nt, Artificial Sequence
  Synthetic
uccccacccucaagagaagc

SEQ ID NO: 3367 - RNA, 20 nt, Artificial Sequence
  Synthetic
ucacagcagaguggcccuuu

SEQ ID NO: 3368 - RNA, 20 nt, Artificial Sequence
  Synthetic
gauugagagggaauuggaac

SEQ ID NO: 3369 - RNA, 20 nt, Artificial Sequence
  Synthetic
uuuugggagaccaaaggcaa

SEQ ID NO: 3370 - RNA, 20 nt, Artificial Sequence
  Synthetic
cccagcuucucuugagggug

SEQ ID NO: 3371 - RNA, 20 nt, Artificial Sequence
  Synthetic
gacugcacucaccucggaac

SEQ ID NO: 3372 - RNA, 20 nt, Artificial Sequence
  Synthetic
ggcaacaggguccgguuccg

SEQ ID NO: 3373 - RNA, 20 nt, Artificial Sequence
  Synthetic
ugacgagguugggggugucc

SEQ ID NO: 3374 - RNA, 20 nt, Artificial Sequence
  Synthetic
uaggcuuugcccucauacau

SEQ ID NO: 3375 - RNA, 20 nt, Artificial Sequence
  Synthetic
ugaagcauaucacuucugcu

SEQ ID NO: 3376 - RNA, 20 nt, Artificial Sequence
  Synthetic
aaucagaauucuugguuuca

SEQ ID NO: 3377 - RNA, 20 nt, Artificial Sequence
  Synthetic
gauguucuaaaaauccuuau

SEQ ID NO: 3378 - RNA, 20 nt, Artificial Sequence
  Synthetic
agacaaaugcuuucugcggg

SEQ ID NO: 3379 - RNA, 20 nt, Artificial Sequence
  Synthetic
uguuaccaucagagauugca

SEQ ID NO: 3380 - RNA, 20 nt, Artificial Sequence
  Synthetic
cccgccaaagcguuuugcgc

SEQ ID NO: 3381 - RNA, 20 nt, Artificial Sequence
  Synthetic
caguuguguggaaauaugau

SEQ ID NO: 3382 - RNA, 20 nt, Artificial Sequence
  Synthetic
acgauguccacaaagaagac

SEQ ID NO: 3383 - RNA, 20 nt, Artificial Sequence
  Synthetic
uuaggcgacaggcauauuca

SEQ ID NO: 3384 - RNA, 20 nt, Artificial Sequence
  Synthetic
gcugguuuaaagcacugaug

SEQ ID NO: 3385 - RNA, 20 nt, Artificial Sequence
  Synthetic
ccaggaaacguccucuuuau

SEQ ID NO: 3386 - RNA, 20 nt, Artificial Sequence
  Synthetic
ucagcccauucccuauaaag

SEQ ID NO: 3387 - RNA, 20 nt, Artificial Sequence
  Synthetic
agaaagcuuucuguaucuca

SEQ ID NO: 3388 - RNA, 20 nt, Artificial Sequence
  Synthetic
acuuauuaaauaaguaugga

SEQ ID NO: 3389 - RNA, 20 nt, Artificial Sequence
  Synthetic
auuggauugcacccaggaau

SEQ ID NO: 3390 - RNA, 20 nt, Artificial Sequence
  Synthetic
ugcuuucagagccaauuccu

SEQ ID NO: 3391 - RNA, 20 nt, Artificial Sequence
  Synthetic
uucugccccuugguccaaaa

SEQ ID NO: 3392 - RNA, 20 nt, Artificial Sequence
  Synthetic
caaauggugagcugagggac

SEQ ID NO: 3393 - RNA, 20 nt, Artificial Sequence
  Synthetic
ccuuuagcuuccaccacucu

SEQ ID NO: 3394 - RNA, 20 nt, Artificial Sequence
  Synthetic
aggucaaccuaguuuaaaua

SEQ ID NO: 3395 - RNA, 20 nt, Artificial Sequence
  Synthetic
uugguugccugucuucuuug

SEQ ID NO: 3396 - RNA, 20 nt, Artificial Sequence
  Synthetic
agaaauccgagagugagccc

SEQ ID NO: 3397 - RNA, 20 nt, Artificial Sequence
  Synthetic
acugcaaccuuccgcccgcc

SEQ ID NO: 3398 - RNA, 20 nt, Artificial Sequence
  Synthetic
aucgauugaacccaggcggg

SEQ ID NO: 3399 - RNA, 20 nt, Artificial Sequence
  Synthetic
uaggcgacaggcauauucau

SEQ ID NO: 3400 - RNA, 20 nt, Artificial Sequence
  Synthetic
ggcguguuccaggaagagca

SEQ ID NO: 3401 - RNA, 20 nt, Artificial Sequence
  Synthetic
caagcacacgcucaccucga

SEQ ID NO: 3402 - RNA, 20 nt, Artificial Sequence
  Synthetic
uuuauuauuauaugcaucau

SEQ ID NO: 3403 - RNA, 20 nt, Artificial Sequence
  Synthetic
aucucaggguucuugccuug

SEQ ID NO: 3404 - RNA, 20 nt, Artificial Sequence
  Synthetic
cuuauuuaauaaguuuuaca

SEQ ID NO: 3405 - RNA, 20 nt, Artificial Sequence
  Synthetic
ggcaaccaauuucuaacauc

SEQ ID NO: 3406 - RNA, 20 nt, Artificial Sequence
  Synthetic
agaagcaguggaggguaaau

SEQ ID NO: 3407 - RNA, 20 nt, Artificial Sequence
  Synthetic
aucacagaagccaucuaaac

SEQ ID NO: 3408 - RNA, 20 nt, Artificial Sequence
  Synthetic
gcuggcuuggcccagggugg

SEQ ID NO: 3409 - RNA, 20 nt, Artificial Sequence
  Synthetic
uuuagcaauguuuacugggu

SEQ ID NO: 3410 - RNA, 20 nt, Artificial Sequence
  Synthetic
cuguuuguucagauucgugu

SEQ ID NO: 3411 - RNA, 20 nt, Artificial Sequence
  Synthetic
acugagaaaacugcagaagc

SEQ ID NO: 3412 - RNA, 20 nt, Artificial Sequence
  Synthetic
uaaauuaauuaaaauuggcc

SEQ ID NO: 3413 - RNA, 20 nt, Artificial Sequence
  Synthetic
ucuccaggugcccugcaacg

SEQ ID NO: 3414 - RNA, 20 nt, Artificial Sequence
  Synthetic
uucccacuggcccacguugc

SEQ ID NO: 3415 - RNA, 20 nt, Artificial Sequence
  Synthetic
ucgcuuagcauaugugguug

SEQ ID NO: 3416 - RNA, 20 nt, Artificial Sequence
  Synthetic
gaugcuucuggaacucaagg

SEQ ID NO: 3417 - RNA, 20 nt, Artificial Sequence
  Synthetic
cagcaugugccaagcccucg

SEQ ID NO: 3418 - RNA, 20 nt, Artificial Sequence
  Synthetic
ucacaacaacuucggccucc

SEQ ID NO: 3419 - RNA, 20 nt, Artificial Sequence
  Synthetic
aucaucgcagaagguugcau

SEQ ID NO: 3420 - RNA, 20 nt, Artificial Sequence
  Synthetic
ggccuuuaacagcacuugaa

SEQ ID NO: 3421 - RNA, 20 nt, Artificial Sequence
  Synthetic
cgaggcgggcaaaccacuug

SEQ ID NO: 3422 - RNA, 20 nt, Artificial Sequence
  Synthetic
ucugaagggcccugucaguu

SEQ ID NO: 3423 - RNA, 20 nt, Artificial Sequence
  Synthetic
agaaauaucucagccucuaa

SEQ ID NO: 3424 - RNA, 20 nt, Artificial Sequence
  Synthetic
gaugcuggcuuggcccaggg

SEQ ID NO: 3425 - RNA, 20 nt, Artificial Sequence
  Synthetic
ccacggcaaguguggcaaca

SEQ ID NO: 3426 - RNA, 20 nt, Artificial Sequence
  Synthetic
ccaagcacacgcucaccucg

SEQ ID NO: 3427 - RNA, 20 nt, Artificial Sequence
  Synthetic
caucuucacaccgcaauguu

SEQ ID NO: 3428 - RNA, 20 nt, Artificial Sequence
  Synthetic
uuguguggaaauaugauugg

SEQ ID NO: 3429 - RNA, 20 nt, Artificial Sequence
  Synthetic
cugcuuagauuuucuugcug

SEQ ID NO: 3430 - RNA, 20 nt, Artificial Sequence
  Synthetic
cuccaggugcccugcaacgu

SEQ ID NO: 3431 - RNA, 20 nt, Artificial Sequence
  Synthetic
gaugcaucccauuguacagc

SEQ ID NO: 3432 - RNA, 20 nt, Artificial Sequence
  Synthetic
gaagguuucagcgaagacaa

SEQ ID NO: 3433 - RNA, 20 nt, Artificial Sequence
  Synthetic
guagugcccacaggaucugc

SEQ ID NO: 3434 - RNA, 20 nt, Artificial Sequence
  Synthetic
ucagguucccagcuguacaa

SEQ ID NO: 3435 - RNA, 20 nt, Artificial Sequence
  Synthetic
uccaaaauuggauugcaccc

SEQ ID NO: 3436 - RNA, 20 nt, Artificial Sequence
  Synthetic
cucccucugguacaauguug

SEQ ID NO: 3437 - RNA, 20 nt, Artificial Sequence
  Synthetic
caccugugggcaaagcauuc

SEQ ID NO: 3438 - RNA, 20 nt, Artificial Sequence
  Synthetic
aggaccauccagggcaaauu

SEQ ID NO: 3439 - RNA, 20 nt, Artificial Sequence
  Synthetic
aguaacaaaagucaucagcc

SEQ ID NO: 3440 - RNA, 20 nt, Artificial Sequence
  Synthetic
cugcaaccuuccgcccgccu

SEQ ID NO: 3441 - RNA, 20 nt, Artificial Sequence
  Synthetic
acagaugcuucuggaacuca

SEQ ID NO: 3442 - RNA, 20 nt, Artificial Sequence
  Synthetic
gggcgggcggaaggggaaga

SEQ ID NO: 3443 - RNA, 20 nt, Artificial Sequence
  Synthetic
cccuguugccacacuugccg

SEQ ID NO: 3444 - RNA, 20 nt, Artificial Sequence
  Synthetic
cguuuccuggccggacgcag

SEQ ID NO: 3445 - RNA, 20 nt, Artificial Sequence
  Synthetic
cagccuugucaacacuaggu

SEQ ID NO: 3446 - RNA, 20 nt, Artificial Sequence
  Synthetic
ggaccauccagggcaaauug

SEQ ID NO: 3447 - RNA, 20 nt, Artificial Sequence
  Synthetic
guaacaaaagucaucagccu

SEQ ID NO: 3448 - RNA, 20 nt, Artificial Sequence
  Synthetic
augcaucccauuguacagcu

SEQ ID NO: 3449 - RNA, 20 nt, Artificial Sequence
  Synthetic
ucucgcuguguugcucaggg

SEQ ID NO: 3450 - RNA, 20 nt, Artificial Sequence
  Synthetic
acuggggaaguagugcccac

SEQ ID NO: 3451 - RNA, 20 nt, Artificial Sequence
  Synthetic
gcugaagcagauacaccaca

SEQ ID NO: 3452 - RNA, 20 nt, Artificial Sequence
  Synthetic
acugacagcacccaacauug

SEQ ID NO: 3453 - RNA, 20 nt, Artificial Sequence
  Synthetic
ccaucuucacaccgcaaugu

SEQ ID NO: 3454 - RNA, 20 nt, Artificial Sequence
  Synthetic
uacaguggacacaaaaaaag

SEQ ID NO: 3455 - RNA, 20 nt, Artificial Sequence
  Synthetic
gagucucgcuguguugcuca

SEQ ID NO: 3456 - RNA, 20 nt, Artificial Sequence
  Synthetic
auuacugaccacaguuucaa

SEQ ID NO: 3457 - RNA, 20 nt, Artificial Sequence
  Synthetic
augugcuagaugauccauag

SEQ ID NO: 3458 - RNA, 20 nt, Artificial Sequence
  Synthetic
uauccagauggagaugcaua

SEQ ID NO: 3459 - RNA, 20 nt, Artificial Sequence
  Synthetic
ucugagguaccauauccuua

SEQ ID NO: 3460 - RNA, 20 nt, Artificial Sequence
  Synthetic
caggaaacguccucuuuaua

SEQ ID NO: 3461 - RNA, 20 nt, Artificial Sequence
  Synthetic
aauugccuucacuuaggcgu

SEQ ID NO: 3462 - RNA, 20 nt, Artificial Sequence
  Synthetic
agagggagccuuugaaacug

SEQ ID NO: 3463 - RNA, 20 nt, Artificial Sequence
  Synthetic
gcgugugcuuggcguguucc

SEQ ID NO: 3464 - RNA, 20 nt, Artificial Sequence
  Synthetic
uugaaaauaagaaguuggcu

SEQ ID NO: 3465 - RNA, 20 nt, Artificial Sequence
  Synthetic
aucugcgggcagauuacgcg

SEQ ID NO: 3466 - RNA, 20 nt, Artificial Sequence
  Synthetic
guaagcacugaauggccuac

SEQ ID NO: 3467 - RNA, 20 nt, Artificial Sequence
  Synthetic
caggaccauccagggcaaau

SEQ ID NO: 3468 - RNA, 20 nt, Artificial Sequence
  Synthetic
auucugccccuugguccaaa

SEQ ID NO: 3469 - RNA, 20 nt, Artificial Sequence
  Synthetic
augcauaaggcccauagaca

SEQ ID NO: 3470 - RNA, 20 nt, Artificial Sequence
  Synthetic
augcaucuuucccaugucua

SEQ ID NO: 3471 - RNA, 20 nt, Artificial Sequence
  Synthetic
uccugggugcaauccaauuu

SEQ ID NO: 3472 - RNA, 20 nt, Artificial Sequence
  Synthetic
gccuuuccucauggguugca

SEQ ID NO: 3473 - RNA, 20 nt, Artificial Sequence
  Synthetic
agagcugccauuugcggggc

SEQ ID NO: 3474 - RNA, 20 nt, Artificial Sequence
  Synthetic
acaccccaauuugcccugga

SEQ ID NO: 3475 - RNA, 20 nt, Artificial Sequence
  Synthetic
uuucgcugugucugucuacc

SEQ ID NO: 3476 - RNA, 20 nt, Artificial Sequence
  Synthetic
uuacaaaaaugauccgggcg

SEQ ID NO: 3477 - RNA, 20 nt, Artificial Sequence
  Synthetic
cugcuuucagagccaauucc

SEQ ID NO: 3478 - RNA, 20 nt, Artificial Sequence
  Synthetic
ccccacccucaagagaagcu

SEQ ID NO: 3479 - RNA, 20 nt, Artificial Sequence
  Synthetic
gguugcccaggggcuggggg

SEQ ID NO: 3480 - RNA, 20 nt, Artificial Sequence
  Synthetic
guccacaacauuguaccaga

SEQ ID NO: 3481 - RNA, 20 nt, Artificial Sequence
  Synthetic
accugugggcaaagcauucu

SEQ ID NO: 3482 - RNA, 20 nt, Artificial Sequence
  Synthetic
uuccaaguagcucggaucac

SEQ ID NO: 3483 - RNA, 20 nt, Artificial Sequence
  Synthetic
cagugugguggcugcaggug

SEQ ID NO: 3484 - RNA, 20 nt, Artificial Sequence
  Synthetic
auuuucccacauuauguaua

SEQ ID NO: 3485 - RNA, 20 nt, Artificial Sequence
  Synthetic
gggaugagcucuuaaaagaa

SEQ ID NO: 3486 - RNA, 20 nt, Artificial Sequence
  Synthetic
uagaauuuaauauuccaaac

SEQ ID NO: 3487 - RNA, 20 nt, Artificial Sequence
  Synthetic
gagguuuccugacucucagu

SEQ ID NO: 3488 - RNA, 20 nt, Artificial Sequence
  Synthetic
aaucuaagcagacucuuuca

SEQ ID NO: 3489 - RNA, 20 nt, Artificial Sequence
  Synthetic
uuugggagaccaaaggcaag

SEQ ID NO: 3490 - RNA, 20 nt, Artificial Sequence
  Synthetic
aauguaccuugcaacccaug

SEQ ID NO: 3491 - RNA, 20 nt, Artificial Sequence
  Synthetic
agugaaauauuucgauuaug

SEQ ID NO: 3492 - RNA, 20 nt, Artificial Sequence
  Synthetic
cagaugcuucuggaacucaa

SEQ ID NO: 3493 - RNA, 20 nt, Artificial Sequence
  Synthetic
aguagugcccacaggaucug

SEQ ID NO: 3494 - RNA, 20 nt, Artificial Sequence
  Synthetic
cuccugggcccuuguuccac

SEQ ID NO: 3495 - RNA, 20 nt, Artificial Sequence
  Synthetic
uaauaaguuuuacauggcac

SEQ ID NO: 3496 - RNA, 20 nt, Artificial Sequence
  Synthetic
ucugcucagaauuucuccuc

SEQ ID NO: 3497 - RNA, 20 nt, Artificial Sequence
  Synthetic
aggagggggcaaggaguaaa

SEQ ID NO: 3498 - RNA, 20 nt, Artificial Sequence
  Synthetic
uagagcugccauuugcgggg

SEQ ID NO: 3499 - RNA, 20 nt, Artificial Sequence
  Synthetic
acaguuucaaaggcucccuc

SEQ ID NO: 3500 - RNA, 20 nt, Artificial Sequence
  Synthetic
cgguagccacuaguuucaug

SEQ ID NO: 3501 - RNA, 20 nt, Artificial Sequence
  Synthetic
ccuuacaccccaauuugccc

SEQ ID NO: 3502 - RNA, 20 nt, Artificial Sequence
  Synthetic
aagaaauacaauaaauuagc

SEQ ID NO: 3503 - RNA, 20 nt, Artificial Sequence
  Synthetic
cuaaaccugaguguaaaaaa

SEQ ID NO: 3504 - RNA, 20 nt, Artificial Sequence
  Synthetic
ccagucccagcuucucuuga

SEQ ID NO: 3505 - RNA, 20 nt, Artificial Sequence
  Synthetic
agaaacggaagucugaggcu

SEQ ID NO: 3506 - RNA, 20 nt, Artificial Sequence
  Synthetic
cccaggagaagacaggccac

SEQ ID NO: 3507 - RNA, 20 nt, Artificial Sequence
  Synthetic
aagucgauccgugguugccc

SEQ ID NO: 3508 - RNA, 20 nt, Artificial Sequence
  Synthetic
aagaaacggaagucugaggc

SEQ ID NO: 3509 - RNA, 20 nt, Artificial Sequence
  Synthetic
gccacggcaaguguggcaac

SEQ ID NO: 3510 - RNA, 20 nt, Artificial Sequence
  Synthetic
augacgagguuggggguguc

SEQ ID NO: 3511 - RNA, 20 nt, Artificial Sequence
  Synthetic
aaagccuaaucaccucccaa

SEQ ID NO: 3512 - RNA, 20 nt, Artificial Sequence
  Synthetic
ggucucccaaaaagaggauc

SEQ ID NO: 3513 - RNA, 20 nt, Artificial Sequence
  Synthetic
uagguuugauggccugcuuc

SEQ ID NO: 3514 - RNA, 20 nt, Artificial Sequence
  Synthetic
cuuggcgcuauacuaggacu

SEQ ID NO: 3515 - RNA, 20 nt, Artificial Sequence
  Synthetic
ggaaacgcuaccaucaaaua

SEQ ID NO: 3516 - RNA, 20 nt, Artificial Sequence
  Synthetic
ccuacugugugcccuacccu

SEQ ID NO: 3517 - RNA, 20 nt, Artificial Sequence
  Synthetic
caucccucuggcccagggua

SEQ ID NO: 3518 - RNA, 20 nt, Artificial Sequence
  Synthetic
uggagcaucccucuggccca

SEQ ID NO: 3519 - RNA, 20 nt, Artificial Sequence
  Synthetic
uguagaugcucugcuuuuga

SEQ ID NO: 3520 - RNA, 20 nt, Artificial Sequence
  Synthetic
guagucccagcuaccauggg

SEQ ID NO: 3521 - RNA, 20 nt, Artificial Sequence
  Synthetic
gcuuggcgcuauacuaggac

SEQ ID NO: 3522 - RNA, 20 nt, Artificial Sequence
  Synthetic
aaaaaaacaagucugggaaa

SEQ ID NO: 3523 - RNA, 20 nt, Artificial Sequence
  Synthetic
ugcccccucccuccugaagc

SEQ ID NO: 3524 - RNA, 20 nt, Artificial Sequence
  Synthetic
cuaaaauuacaaaaaugauc

SEQ ID NO: 3525 - RNA, 20 nt, Artificial Sequence
  Synthetic
ucucucugcucacuuccaua

SEQ ID NO: 3526 - RNA, 20 nt, Artificial Sequence
  Synthetic
uccucuuuuugggagaccaa

SEQ ID NO: 3527 - RNA, 20 nt, Artificial Sequence
  Synthetic
ucacagaagccaucuaaaca

SEQ ID NO: 3528 - RNA, 20 nt, Artificial Sequence
  Synthetic
aauguuuacugggugggugg

SEQ ID NO: 3529 - RNA, 20 nt, Artificial Sequence
  Synthetic
gcgcacaugucucuuagccu

SEQ ID NO: 3530 - RNA, 20 nt, Artificial Sequence
  Synthetic
ugcugguuuaaagcacugau

SEQ ID NO: 3531 - RNA, 20 nt, Artificial Sequence
  Synthetic
gccuuuggucucccaaaaag

SEQ ID NO: 3532 - RNA, 20 nt, Artificial Sequence
  Synthetic
cagugccagauccucuuuuu

SEQ ID NO: 3533 - RNA, 20 nt, Artificial Sequence
  Synthetic
cgggcagauuacgcguggca

SEQ ID NO: 3534 - RNA, 20 nt, Artificial Sequence
  Synthetic
gagagucuuaggagaugacg

SEQ ID NO: 3535 - RNA, 20 nt, Artificial Sequence
  Synthetic
aaggggcaagcuagugauac

SEQ ID NO: 3536 - RNA, 20 nt, Artificial Sequence
  Synthetic
guggaguuuggccaggcugu

SEQ ID NO: 3537 - RNA, 20 nt, Artificial Sequence
  Synthetic
cccacucuucuccgacagcc

SEQ ID NO: 3538 - RNA, 20 nt, Artificial Sequence
  Synthetic
auauggcaccuggacacaca

SEQ ID NO: 3539 - RNA, 20 nt, Artificial Sequence
  Synthetic
gcauuugucuguagacagcc

SEQ ID NO: 3540 - RNA, 20 nt, Artificial Sequence
  Synthetic
guugcccaggggcuggggga

SEQ ID NO: 3541 - RNA, 20 nt, Artificial Sequence
  Synthetic
agaugcuucuggaacucaag

SEQ ID NO: 3542 - RNA, 20 nt, Artificial Sequence
  Synthetic
gcuggauucugacuacacug

SEQ ID NO: 3543 - RNA, 20 nt, Artificial Sequence
  Synthetic
aaaaaaaaagucauuguucu

SEQ ID NO: 3544 - RNA, 20 nt, Artificial Sequence
  Synthetic
aggccuggggguggagcccg

SEQ ID NO: 3545 - RNA, 20 nt, Artificial Sequence
  Synthetic
auuaauguagcaaaguggac

SEQ ID NO: 3546 - RNA, 20 nt, Artificial Sequence
  Synthetic
gcccugcaacgugggccagu

SEQ ID NO: 3547 - RNA, 20 nt, Artificial Sequence
  Synthetic
uucucuuacaccgcacauau

SEQ ID NO: 3548 - RNA, 20 nt, Artificial Sequence
  Synthetic
aaaaauagguuuaaaaauau

SEQ ID NO: 3549 - RNA, 20 nt, Artificial Sequence
  Synthetic
cacaacaacuucggccuccu

SEQ ID NO: 3550 - RNA, 20 nt, Artificial Sequence
  Synthetic
gcaagguuuuauugagugga

SEQ ID NO: 3551 - RNA, 20 nt, Artificial Sequence
  Synthetic
uaucucaggguucuugccuu

SEQ ID NO: 3552 - RNA, 20 nt, Artificial Sequence
  Synthetic
augucugggaaggccgggug

SEQ ID NO: 3553 - RNA, 20 nt, Artificial Sequence
  Synthetic
ugcaucuuucccaugucuau

SEQ ID NO: 3554 - RNA, 20 nt, Artificial Sequence
  Synthetic
ugugaaaguguuacuauuuu

SEQ ID NO: 3555 - RNA, 20 nt, Artificial Sequence
  Synthetic
aagaaagagaauagauagua

SEQ ID NO: 3556 - RNA, 20 nt, Artificial Sequence
  Synthetic
cuagccuaugagcuuuauga

SEQ ID NO: 3557 - RNA, 20 nt, Artificial Sequence
  Synthetic
uccacgcugcugaggcagug

SEQ ID NO: 3558 - RNA, 20 nt, Artificial Sequence
  Synthetic
uuucuauggccagcuucagg

SEQ ID NO: 3559 - RNA, 20 nt, Artificial Sequence
  Synthetic
gggaaggaacgcucuauggu

SEQ ID NO: 3560 - RNA, 20 nt, Artificial Sequence
  Synthetic
gggcagauuacgcguggcag

SEQ ID NO: 3561 - RNA, 20 nt, Artificial Sequence
  Synthetic
cuugccaucauaaagcucau

SEQ ID NO: 3562 - RNA, 20 nt, Artificial Sequence
  Synthetic
gaguuuugauaggcacagga

SEQ ID NO: 3563 - RNA, 20 nt, Artificial Sequence
  Synthetic
gcaagaaauggguccaaaau

SEQ ID NO: 3564 - RNA, 20 nt, Artificial Sequence
  Synthetic
ggaugggacagagcaucucc

SEQ ID NO: 3565 - RNA, 20 nt, Artificial Sequence
  Synthetic
guuccgccgguugauggccu

SEQ ID NO: 3566 - RNA, 20 nt, Artificial Sequence
  Synthetic
uuuuuacacucagguuuagu

SEQ ID NO: 3567 - RNA, 20 nt, Artificial Sequence
  Synthetic
ugcccugcaacgugggccag

SEQ ID NO: 3568 - RNA, 20 nt, Artificial Sequence
  Synthetic
ugggccagugggaagguuug

SEQ ID NO: 3569 - RNA, 20 nt, Artificial Sequence
  Synthetic
gacaaaugcuuucugcggga

SEQ ID NO: 3570 - RNA, 20 nt, Artificial Sequence
  Synthetic
cagauuacgcguggcagggg

SEQ ID NO: 3571 - RNA, 20 nt, Artificial Sequence
  Synthetic
gcccugcaggaacuggcucc

SEQ ID NO: 3572 - RNA, 20 nt, Artificial Sequence
  Synthetic
ucuuuagcagguagaguacc

SEQ ID NO: 3573 - RNA, 20 nt, Artificial Sequence
  Synthetic
caccuaccaagcccgacucc

SEQ ID NO: 3574 - RNA, 20 nt, Artificial Sequence
  Synthetic
cuccuggagucgggcuuggu

SEQ ID NO: 3575 - RNA, 20 nt, Artificial Sequence
  Synthetic
gaugcuuuucuccuggaguc

SEQ ID NO: 3576 - RNA, 20 nt, Artificial Sequence
  Synthetic
acugaccuuccuagguuuga

SEQ ID NO: 3577 - RNA, 20 nt, Artificial Sequence
  Synthetic
gcaggccaucaaaccuagga

SEQ ID NO: 3578 - RNA, 20 nt, Artificial Sequence
  Synthetic
cucaucccugacuaucugcu

SEQ ID NO: 3579 - RNA, 20 nt, Artificial Sequence
  Synthetic
gugggccagugggaagguuu

SEQ ID NO: 3580 - RNA, 20 nt, Artificial Sequence
  Synthetic
agaaucgauugaacccaggc

SEQ ID NO: 3581 - RNA, 20 nt, Artificial Sequence
  Synthetic
acguccucuuuauagggaau

SEQ ID NO: 3582 - RNA, 20 nt, Artificial Sequence
  Synthetic
cuauuuggcaauuuauacaa

SEQ ID NO: 3583 - RNA, 20 nt, Artificial Sequence
  Synthetic
caaaaaucagcugggcuuug

SEQ ID NO: 3584 - RNA, 20 nt, Artificial Sequence
  Synthetic
ggcugugaggcaguuucuga

SEQ ID NO: 3585 - RNA, 20 nt, Artificial Sequence
  Synthetic
cguacaaaaggggccgggcg

SEQ ID NO: 3586 - RNA, 20 nt, Artificial Sequence
  Synthetic
cuucuuauuuucaaauccaa

SEQ ID NO: 3587 - RNA, 20 nt, Artificial Sequence
  Synthetic
cguuccgccgguugauggcc

SEQ ID NO: 3588 - RNA, 20 nt, Artificial Sequence
  Synthetic
acuacuaccacauuggugac

SEQ ID NO: 3589 - RNA, 20 nt, Artificial Sequence
  Synthetic
cacaaggggcuugaggaccc

SEQ ID NO: 3590 - RNA, 20 nt, Artificial Sequence
  Synthetic
uuauagggaaugggcugagc

SEQ ID NO: 3591 - RNA, 20 nt, Artificial Sequence
  Synthetic
cuuuagcagguagaguaccu

SEQ ID NO: 3592 - RNA, 20 nt, Artificial Sequence
  Synthetic
ccuagacacugccguggguu

SEQ ID NO: 3593 - RNA, 20 nt, Artificial Sequence
  Synthetic
gcuguggggcuccaaaccca

SEQ ID NO: 3594 - RNA, 20 nt, Artificial Sequence
  Synthetic
cauagcgggugaguaaccag

SEQ ID NO: 3595 - RNA, 20 nt, Artificial Sequence
  Synthetic
cucuuagccuaggaagauuc

SEQ ID NO: 3596 - RNA, 20 nt, Artificial Sequence
  Synthetic
uaaagaaauugccuucacuu

SEQ ID NO: 3597 - RNA, 20 nt, Artificial Sequence
  Synthetic
uucauccaacgccuaaguga

SEQ ID NO: 3598 - RNA, 20 nt, Artificial Sequence
  Synthetic
uggcuggauucugacuacac

SEQ ID NO: 3599 - RNA, 20 nt, Artificial Sequence
  Synthetic
cuacuaccacauuggugacu

SEQ ID NO: 3600 - RNA, 20 nt, Artificial Sequence
  Synthetic
uacuucgaugggcuaugcag

SEQ ID NO: 3601 - RNA, 20 nt, Artificial Sequence
  Synthetic
uguccaggugccauauuuga

SEQ ID NO: 3602 - RNA, 20 nt, Artificial Sequence
  Synthetic
ugcauaaggcccauagacau

SEQ ID NO: 3603 - RNA, 20 nt, Artificial Sequence
  Synthetic
gcccaggggcugggggaggg

SEQ ID NO: 3604 - RNA, 20 nt, Artificial Sequence
  Synthetic
accuugcaacccaugaggaa

SEQ ID NO: 3605 - RNA, 20 nt, Artificial Sequence
  Synthetic
auuacgcguggcaggggugg

SEQ ID NO: 3606 - RNA, 20 nt, Artificial Sequence
  Synthetic
uguguguguugggugggagu

SEQ ID NO: 3607 - RNA, 20 nt, Artificial Sequence
  Synthetic
aucauaauacaucucagagg

SEQ ID NO: 3608 - RNA, 20 nt, Artificial Sequence
  Synthetic
cuaccauccuauggccacca

SEQ ID NO: 3609 - RNA, 20 nt, Artificial Sequence
  Synthetic
aaccucuuuggaaaacuauu

SEQ ID NO: 3610 - RNA, 20 nt, Artificial Sequence
  Synthetic
ccccuugugagcagagagug

SEQ ID NO: 3611 - RNA, 20 nt, Artificial Sequence
  Synthetic
caugaaccuugagauaagug

SEQ ID NO: 3612 - RNA, 20 nt, Artificial Sequence
  Synthetic
cagaaaaacuucacacugcu

SEQ ID NO: 3613 - RNA, 20 nt, Artificial Sequence
  Synthetic
ggcccauuucaggagagaaa

SEQ ID NO: 3614 - RNA, 20 nt, Artificial Sequence
  Synthetic
uuaaagcacugauggggugc

SEQ ID NO: 3615 - RNA, 20 nt, Artificial Sequence
  Synthetic
gcauauucuggaaaacuuuu

SEQ ID NO: 3616 - RNA, 20 nt, Artificial Sequence
  Synthetic
cuggagcaucccucuggccc

SEQ ID NO: 3617 - RNA, 20 nt, Artificial Sequence
  Synthetic
cuccccccucccccagcccc

SEQ ID NO: 3618 - RNA, 20 nt, Artificial Sequence
  Synthetic
uccccccucccccagccccu

SEQ ID NO: 3619 - RNA, 20 nt, Artificial Sequence
  Synthetic
uccgugguugcccaggggcu

SEQ ID NO: 3620 - RNA, 20 nt, Artificial Sequence
  Synthetic
auccgugguugcccaggggc

SEQ ID NO: 3621 - RNA, 20 nt, Artificial Sequence
  Synthetic
cgacaaaagacagauuaaug

SEQ ID NO: 3622 - RNA, 20 nt, Artificial Sequence
  Synthetic
aagauuagacugaccuuccu

SEQ ID NO: 3623 - RNA, 20 nt, Artificial Sequence
  Synthetic
cuugcugaggaaagaggagg

SEQ ID NO: 3624 - RNA, 20 nt, Artificial Sequence
  Synthetic
gcagagagagaaggaacgac

SEQ ID NO: 3625 - RNA, 20 nt, Artificial Sequence
  Synthetic
cucugcucacaaggggcuug

SEQ ID NO: 3626 - RNA, 20 nt, Artificial Sequence
  Synthetic
gacaaaagacagauuaauga

SEQ ID NO: 3627 - RNA, 20 nt, Artificial Sequence
  Synthetic
aaguaugcaaugaaugucaa

SEQ ID NO: 3628 - RNA, 20 nt, Artificial Sequence
  Synthetic
ccccagccccugggcaacca

SEQ ID NO: 3629 - RNA, 20 nt, Artificial Sequence
  Synthetic
guguuacuauuuuaggcgac

SEQ ID NO: 3630 - RNA, 20 nt, Artificial Sequence
  Synthetic
aaagcagagcaucuacaucg

SEQ ID NO: 3631 - RNA, 20 nt, Artificial Sequence
  Synthetic
gggucuuacucuugucgccc

SEQ ID NO: 3632 - RNA, 20 nt, Artificial Sequence
  Synthetic
uaaaacuuauuaaauaagua

SEQ ID NO: 3633 - RNA, 20 nt, Artificial Sequence
  Synthetic
aucugugggcaagaaaaagg

SEQ ID NO: 3634 - RNA, 20 nt, Artificial Sequence
  Synthetic
gaguaccugggagagagggu

SEQ ID NO: 3635 - RNA, 20 nt, Artificial Sequence
  Synthetic
ccucacucucugcucacaag

SEQ ID NO: 3636 - RNA, 20 nt, Artificial Sequence
  Synthetic
agcugggaaccugaagacaa

SEQ ID NO: 3637 - RNA, 20 nt, Artificial Sequence
  Synthetic
gcgggcagauuacgcguggc

SEQ ID NO: 3638 - RNA, 20 nt, Artificial Sequence
  Synthetic
aacacaaggaaguagggaac

SEQ ID NO: 3639 - RNA, 20 nt, Artificial Sequence
  Synthetic
cucaccagacccaaaucugc

SEQ ID NO: 3640 - RNA, 20 nt, Artificial Sequence
  Synthetic
gaagggagaugcuuuucucc

SEQ ID NO: 3641 - RNA, 20 nt, Artificial Sequence
  Synthetic
aaauggaguuuugguggugu

SEQ ID NO: 3642 - RNA, 20 nt, Artificial Sequence
  Synthetic
ugaagcaggccaucaaaccu

SEQ ID NO: 3643 - RNA, 20 nt, Artificial Sequence
  Synthetic
agguuugauggccugcuuca

SEQ ID NO: 3644 - RNA, 20 nt, Artificial Sequence
  Synthetic
caccucuucuucccugaagc

SEQ ID NO: 3645 - RNA, 20 nt, Artificial Sequence
  Synthetic
acagugccagauccucuuuu

SEQ ID NO: 3646 - RNA, 20 nt, Artificial Sequence
  Synthetic
cuguucaucaagagaugcaa

SEQ ID NO: 3647 - RNA, 20 nt, Artificial Sequence
  Synthetic
ggcugggggaggggggagac

SEQ ID NO: 3648 - RNA, 20 nt, Artificial Sequence
  Synthetic
auaaucugugggcaagaaaa

SEQ ID NO: 3649 - RNA, 20 nt, Artificial Sequence
  Synthetic
uuauuauuauaugcaucaua

SEQ ID NO: 3650 - RNA, 20 nt, Artificial Sequence
  Synthetic
uaaaccuauuuuuauagaga

SEQ ID NO: 3651 - RNA, 20 nt, Artificial Sequence
  Synthetic
aucugcuggcaccuugaucg

SEQ ID NO: 3652 - RNA, 20 nt, Artificial Sequence
  Synthetic
uuguuucuauggccagcuuc

SEQ ID NO: 3653 - RNA, 20 nt, Artificial Sequence
  Synthetic
gaggugagugcagucauccg

SEQ ID NO: 3654 - RNA, 20 nt, Artificial Sequence
  Synthetic
aaaagcagagcaucuacauc

SEQ ID NO: 3655 - RNA, 20 nt, Artificial Sequence
  Synthetic
caagcuagugauacuggagg

SEQ ID NO: 3656 - RNA, 20 nt, Artificial Sequence
  Synthetic
aggauagagcugccauuugc

SEQ ID NO: 3657 - RNA, 20 nt, Artificial Sequence
  Synthetic
agauuacgcguggcaggggu

SEQ ID NO: 3658 - RNA, 20 nt, Artificial Sequence
  Synthetic
aggugagugcagucauccga

SEQ ID NO: 3659 - RNA, 20 nt, Artificial Sequence
  Synthetic
ccuagagugguggaagcuaa

SEQ ID NO: 3660 - RNA, 20 nt, Artificial Sequence
  Synthetic
cgauagacgccggcagcccc

SEQ ID NO: 3661 - RNA, 20 nt, Artificial Sequence
  Synthetic
ccccgcugcucaaaccucug

SEQ ID NO: 3662 - RNA, 20 nt, Artificial Sequence
  Synthetic
acuuuuccucacuuaucuca

SEQ ID NO: 3663 - RNA, 20 nt, Artificial Sequence
  Synthetic
aaucagcugggcuuuguggc

SEQ ID NO: 3664 - RNA, 20 nt, Artificial Sequence
  Synthetic
gccagucccagcuucucuug

SEQ ID NO: 3665 - RNA, 20 nt, Artificial Sequence
  Synthetic
aggggggagacagggagaau

SEQ ID NO: 3666 - RNA, 20 nt, Artificial Sequence
  Synthetic
guguguguguugggugggag

SEQ ID NO: 3667 - RNA, 20 nt, Artificial Sequence
  Synthetic
gggaggaucaugagaguugg

SEQ ID NO: 3668 - RNA, 20 nt, Artificial Sequence
  Synthetic
aaguguccuucaagggguca

SEQ ID NO: 3669 - RNA, 20 nt, Artificial Sequence
  Synthetic
uaccauccuauggccaccag

SEQ ID NO: 3670 - RNA, 20 nt, Artificial Sequence
  Synthetic
ccuaccauccuauggccacc

SEQ ID NO: 3671 - RNA, 20 nt, Artificial Sequence
  Synthetic
ccagcuaccaugggaggcug

SEQ ID NO: 3672 - RNA, 20 nt, Artificial Sequence
  Synthetic
cugauucuuccgauacccca

SEQ ID NO: 3673 - RNA, 20 nt, Artificial Sequence
  Synthetic
cgugguugcccaggggcugg

SEQ ID NO: 3674 - RNA, 20 nt, Artificial Sequence
  Synthetic
gaggauagagcugccauuug

SEQ ID NO: 3675 - RNA, 20 nt, Artificial Sequence
  Synthetic
agucugaggcuggggcaacu

SEQ ID NO: 3676 - RNA, 20 nt, Artificial Sequence
  Synthetic
agaugcuuuucuccuggagu

SEQ ID NO: 3677 - RNA, 20 nt, Artificial Sequence
  Synthetic
cccauggugaguacuucgau

SEQ ID NO: 3678 - RNA, 20 nt, Artificial Sequence
  Synthetic
caacaauuaaugagaaagua

SEQ ID NO: 3679 - RNA, 20 nt, Artificial Sequence
  Synthetic
caauuugcccuggauggucc

SEQ ID NO: 3680 - RNA, 20 nt, Artificial Sequence
  Synthetic
cguaacauacccaguaccac

SEQ ID NO: 3681 - RNA, 20 nt, Artificial Sequence
  Synthetic
ucuugcugaggaaagaggag

SEQ ID NO: 3682 - RNA, 20 nt, Artificial Sequence
  Synthetic
gguccacaacauuguaccag

SEQ ID NO: 3683 - RNA, 20 nt, Artificial Sequence
  Synthetic
ucauaauacaucucagaggu

SEQ ID NO: 3684 - RNA, 20 nt, Artificial Sequence
  Synthetic
agggaugagcucuuaaaaga

SEQ ID NO: 3685 - RNA, 20 nt, Artificial Sequence
  Synthetic
cccaggguagggcacacagu

SEQ ID NO: 3686 - RNA, 20 nt, Artificial Sequence
  Synthetic
uacagacaaaugcuuucugc

SEQ ID NO: 3687 - RNA, 20 nt, Artificial Sequence
  Synthetic
uaaagcgcgccuuuccucau

SEQ ID NO: 3688 - RNA, 20 nt, Artificial Sequence
  Synthetic
aguggcccuuuuggaccaag

SEQ ID NO: 3689 - RNA, 20 nt, Artificial Sequence
  Synthetic
ccucacugagaaggugaugu

SEQ ID NO: 3690 - RNA, 20 nt, Artificial Sequence
  Synthetic
ggagaaaacacaaggaagua

SEQ ID NO: 3691 - RNA, 20 nt, Artificial Sequence
  Synthetic
aagcuagugauacuggaggg

SEQ ID NO: 3692 - RNA, 20 nt, Artificial Sequence
  Synthetic
cguugagaggagugcgccgg

SEQ ID NO: 3693 - RNA, 20 nt, Artificial Sequence
  Synthetic
ucugggaaauggaguuuugg

SEQ ID NO: 3694 - RNA, 20 nt, Artificial Sequence
  Synthetic
uugcccaggggcugggggag

SEQ ID NO: 3695 - RNA, 20 nt, Artificial Sequence
  Synthetic
ggggcgaauguuuacagcug

SEQ ID NO: 3696 - RNA, 20 nt, Artificial Sequence
  Synthetic
ucaaaaugucugggaaggcc

SEQ ID NO: 3697 - RNA, 20 nt, Artificial Sequence
  Synthetic
uggcccauuucaggagagaa

SEQ ID NO: 3698 - RNA, 20 nt, Artificial Sequence
  Synthetic
uucucaguauuuggaaagac

SEQ ID NO: 3699 - RNA, 20 nt, Artificial Sequence
  Synthetic
ggguggggaggucacagaac

SEQ ID NO: 3700 - RNA, 20 nt, Artificial Sequence
  Synthetic
uucuggacaguucauuucaa

SEQ ID NO: 3701 - RNA, 20 nt, Artificial Sequence
  Synthetic
agaaagaaggaaauugcuuc

SEQ ID NO: 3702 - RNA, 20 nt, Artificial Sequence
  Synthetic
gcaagguggucuaaccucuu

SEQ ID NO: 3703 - RNA, 20 nt, Artificial Sequence
  Synthetic
uuccgccgguugauggccug

SEQ ID NO: 3704 - RNA, 20 nt, Artificial Sequence
  Synthetic
gcccauggugaguacuucga

SEQ ID NO: 3705 - RNA, 20 nt, Artificial Sequence
  Synthetic
ggggcaaacauuguguauga

SEQ ID NO: 3706 - RNA, 20 nt, Artificial Sequence
  Synthetic
uaaguauauuuacagauuug

SEQ ID NO: 3707 - RNA, 20 nt, Artificial Sequence
  Synthetic
ccgugguugcccaggggcug

SEQ ID NO: 3708 - RNA, 20 nt, Artificial Sequence
  Synthetic
aaucugcccgcagauccugu

SEQ ID NO: 3709 - RNA, 20 nt, Artificial Sequence
  Synthetic
acacaaggaaguagggaaca

SEQ ID NO: 3710 - RNA, 20 nt, Artificial Sequence
  Synthetic
gccaggcugucggagaagag

SEQ ID NO: 3711 - RNA, 20 nt, Artificial Sequence
  Synthetic
uuaauguagcaaaguggaca

SEQ ID NO: 3712 - RNA, 20 nt, Artificial Sequence
  Synthetic
ugcaacgugggccaguggga

SEQ ID NO: 3713 - RNA, 20 nt, Artificial Sequence
  Synthetic
agcuccccaaaccuucccac

SEQ ID NO: 3714 - RNA, 20 nt, Artificial Sequence
  Synthetic
agaguggcccuuuuggacca

SEQ ID NO: 3715 - RNA, 20 nt, Artificial Sequence
  Synthetic
acuacauuaauguagcaaag

SEQ ID NO: 3716 - RNA, 20 nt, Artificial Sequence
  Synthetic
ugacuagucccaugugguau

SEQ ID NO: 3717 - RNA, 20 nt, Artificial Sequence
  Synthetic
gaugcuauuaauaauucugu

SEQ ID NO: 3718 - RNA, 20 nt, Artificial Sequence
  Synthetic
cugccucgggcuccaccccc

SEQ ID NO: 3719 - RNA, 20 nt, Artificial Sequence
  Synthetic
gguugauggccuggggcugc

SEQ ID NO: 3720 - RNA, 20 nt, Artificial Sequence
  Synthetic
uaguaagauguggggccuuu

SEQ ID NO: 3721 - RNA, 20 nt, Artificial Sequence
  Synthetic
caacuccugaauagcacauu

SEQ ID NO: 3722 - RNA, 20 nt, Artificial Sequence
  Synthetic
cguuaauccauauuuaaacu

SEQ ID NO: 3723 - RNA, 20 nt, Artificial Sequence
  Synthetic
gcugggggaggggggagaca

SEQ ID NO: 3724 - RNA, 20 nt, Artificial Sequence
  Synthetic
agaagguuucagcgaagaca

SEQ ID NO: 3725 - RNA, 20 nt, Artificial Sequence
  Synthetic
gaaacggaagucugaggcug

SEQ ID NO: 3726 - RNA, 20 nt, Artificial Sequence
  Synthetic
ucuacgggaagauauccugu

SEQ ID NO: 3727 - RNA, 20 nt, Artificial Sequence
  Synthetic
gaaaaaaaaaaaaacaaguc

SEQ ID NO: 3728 - RNA, 20 nt, Artificial Sequence
  Synthetic
agaaaaacuucacacugcua

SEQ ID NO: 3729 - RNA, 20 nt, Artificial Sequence
  Synthetic
uucuugcugaggaaagagga

SEQ ID NO: 3730 - RNA, 20 nt, Artificial Sequence
  Synthetic
caggaauuggcucugaaagc

SEQ ID NO: 3731 - RNA, 20 nt, Artificial Sequence
  Synthetic
caaaagcagagcaucuacau

SEQ ID NO: 3732 - RNA, 20 nt, Artificial Sequence
  Synthetic
cccgcugcucaaaccucugg

SEQ ID NO: 3733 - RNA, 20 nt, Artificial Sequence
  Synthetic
cacacuugccguggccagcc

SEQ ID NO: 3734 - RNA, 20 nt, Artificial Sequence
  Synthetic
accuauuuuuauagagaugg

SEQ ID NO: 3735 - RNA, 20 nt, Artificial Sequence
  Synthetic
aggagggagggggcaggagc

SEQ ID NO: 3736 - RNA, 20 nt, Artificial Sequence
  Synthetic
gucgauccgugguugcccag

SEQ ID NO: 3737 - RNA, 20 nt, Artificial Sequence
  Synthetic
caaguggcuggacgugcaga

SEQ ID NO: 3738 - RNA, 20 nt, Artificial Sequence
  Synthetic
ggauuucucuucuuugugau

SEQ ID NO: 3739 - RNA, 20 nt, Artificial Sequence
  Synthetic
gcaauuagggucuaguuggc

SEQ ID NO: 3740 - RNA, 20 nt, Artificial Sequence
  Synthetic
ggggggagacagggagaaug

SEQ ID NO: 3741 - RNA, 20 nt, Artificial Sequence
  Synthetic
agaggguggggccucaaagc

SEQ ID NO: 3742 - RNA, 20 nt, Artificial Sequence
  Synthetic
ccaucccacugccugcuuug

SEQ ID NO: 3743 - RNA, 20 nt, Artificial Sequence
  Synthetic
aagcaggcagugggauggag

SEQ ID NO: 3744 - RNA, 20 nt, Artificial Sequence
  Synthetic
ccccagagguuugagcagcg

SEQ ID NO: 3745 - RNA, 20 nt, Artificial Sequence
  Synthetic
cagggcaugcaagggaggug

SEQ ID NO: 3746 - RNA, 20 nt, Artificial Sequence
  Synthetic
uuuuguucguuauagaauuu

SEQ ID NO: 3747 - RNA, 20 nt, Artificial Sequence
  Synthetic
aaauaugauuggaggaucaa

SEQ ID NO: 3748 - RNA, 20 nt, Artificial Sequence
  Synthetic
cugcugguuuaaagcacuga

SEQ ID NO: 3749 - RNA, 20 nt, Artificial Sequence
  Synthetic
gauuuucuugcugaggaaag

SEQ ID NO: 3750 - RNA, 20 nt, Artificial Sequence
  Synthetic
cauuugucuguagacagccu

SEQ ID NO: 3751 - RNA, 20 nt, Artificial Sequence
  Synthetic
auccgagggagagaagaugc

SEQ ID NO: 3752 - RNA, 20 nt, Artificial Sequence
  Synthetic
ccaacauugcggugugaaga

SEQ ID NO: 3753 - RNA, 20 nt, Artificial Sequence
  Synthetic
guaguaagauguggggccuu

SEQ ID NO: 3754 - RNA, 20 nt, Artificial Sequence
  Synthetic
ucaacuccugaauagcacau

SEQ ID NO: 3755 - RNA, 20 nt, Artificial Sequence
  Synthetic
agaaaauaaauuaaaaagca

SEQ ID NO: 3756 - RNA, 20 nt, Artificial Sequence
  Synthetic
ccaaaggcaagggguguugg

SEQ ID NO: 3757 - RNA, 20 nt, Artificial Sequence
  Synthetic
uugauguugaccuaacugac

SEQ ID NO: 3758 - RNA, 20 nt, Artificial Sequence
  Synthetic
ccuuccgcccgccccgcaaa

SEQ ID NO: 3759 - RNA, 20 nt, Artificial Sequence
  Synthetic
gcugccauuugcggggcggg

SEQ ID NO: 3760 - RNA, 20 nt, Artificial Sequence
  Synthetic
ggauagagcugccauuugcg

SEQ ID NO: 3761 - RNA, 20 nt, Artificial Sequence
  Synthetic
agcgaggaacaucacacacu

SEQ ID NO: 3762 - RNA, 20 nt, Artificial Sequence
  Synthetic
aauaugauuggaggaucaaa

SEQ ID NO: 3763 - RNA, 20 nt, Artificial Sequence
  Synthetic
auugaacccaggcgggcgga

SEQ ID NO: 3764 - RNA, 20 nt, Artificial Sequence
  Synthetic
aagucugaggcuggggcaac

SEQ ID NO: 3765 - RNA, 20 nt, Artificial Sequence
  Synthetic
gauuacgcguggcaggggug

SEQ ID NO: 3766 - RNA, 20 nt, Artificial Sequence
  Synthetic
uaaucugcccgcagauccug

SEQ ID NO: 3767 - RNA, 20 nt, Artificial Sequence
  Synthetic
auagauaguauggaaaauua

SEQ ID NO: 3768 - RNA, 20 nt, Artificial Sequence
  Synthetic
uggagaggagagaaagcccc

SEQ ID NO: 3769 - RNA, 20 nt, Artificial Sequence
  Synthetic
agaggagagaaagccccugg

SEQ ID NO: 3770 - RNA, 20 nt, Artificial Sequence
  Synthetic
gggcuaugcaggggcugcag

SEQ ID NO: 3771 - RNA, 20 nt, Artificial Sequence
  Synthetic
ccagggcaaauuggggugua

SEQ ID NO: 3772 - RNA, 20 nt, Artificial Sequence
  Synthetic
cgugggccagugggaagguu

SEQ ID NO: 3773 - RNA, 20 nt, Artificial Sequence
  Synthetic
uuggugauuaaaucauugug

SEQ ID NO: 3774 - RNA, 20 nt, Artificial Sequence
  Synthetic
ugucucuugcuagcucaaag

SEQ ID NO: 3775 - RNA, 20 nt, Artificial Sequence
  Synthetic
gggcaagcuagugauacugg

SEQ ID NO: 3776 - RNA, 20 nt, Artificial Sequence
  Synthetic
cuucaauuaggaaaaaauaa

SEQ ID NO: 3777 - RNA, 20 nt, Artificial Sequence
  Synthetic
uagaaaauaaauuaaaaagc

SEQ ID NO: 3778 - RNA, 20 nt, Artificial Sequence
  Synthetic
accuacugugugcccuaccc

SEQ ID NO: 3779 - RNA, 20 nt, Artificial Sequence
  Synthetic
gaguggcccuuuuggaccaa

SEQ ID NO: 3780 - RNA, 20 nt, Artificial Sequence
  Synthetic
auaauaaaguguccuucaag

SEQ ID NO: 3781 - RNA, 20 nt, Artificial Sequence
  Synthetic
cuccaccgucaauagcauuc

SEQ ID NO: 3782 - RNA, 20 nt, Artificial Sequence
  Synthetic
auguugcuggugggggugca

SEQ ID NO: 3783 - RNA, 20 nt, Artificial Sequence
  Synthetic
guacuucgaugggcuaugca

SEQ ID NO: 3784 - RNA, 20 nt, Artificial Sequence
  Synthetic
ccccagccaugcacaaagau

SEQ ID NO: 3785 - RNA, 20 nt, Artificial Sequence
  Synthetic
aguaccugggagagagggug

SEQ ID NO: 3786 - RNA, 20 nt, Artificial Sequence
  Synthetic
guuuugauaggcacaggaug

SEQ ID NO: 3787 - RNA, 20 nt, Artificial Sequence
  Synthetic
ucuguaacacacgccugcug

SEQ ID NO: 3788 - RNA, 20 nt, Artificial Sequence
  Synthetic
aauagcaaagugguuaaagg

SEQ ID NO: 3789 - RNA, 20 nt, Artificial Sequence
  Synthetic
uaucaucagaaaagaaagaa

SEQ ID NO: 3790 - RNA, 20 nt, Artificial Sequence
  Synthetic
gaauuuaaauuaauuaaaau

SEQ ID NO: 3791 - RNA, 20 nt, Artificial Sequence
  Synthetic
cauauauuagcagaaacuga

SEQ ID NO: 3792 - RNA, 20 nt, Artificial Sequence
  Synthetic
gguggggaggucacagaaca

SEQ ID NO: 3793 - RNA, 20 nt, Artificial Sequence
  Synthetic
acaaaugcuuucugcgggag

SEQ ID NO: 3794 - RNA, 20 nt, Artificial Sequence
  Synthetic
agggccucgugggccaugug

SEQ ID NO: 3795 - RNA, 20 nt, Artificial Sequence
  Synthetic
ccugcgcaaaacgcuuuggc

SEQ ID NO: 3796 - RNA, 20 nt, Artificial Sequence
  Synthetic
ccgcucccccaccccacgac

SEQ ID NO: 3797 - RNA, 20 nt, Artificial Sequence
  Synthetic
uaaguaccauauacauaaug

SEQ ID NO: 3798 - RNA, 20 nt, Artificial Sequence
  Synthetic
guguguugggugggaguggg

SEQ ID NO: 3799 - RNA, 20 nt, Artificial Sequence
  Synthetic
aagaaaaagguggacugaaa

SEQ ID NO: 3800 - RNA, 20 nt, Artificial Sequence
  Synthetic
cguuuuuuaauggauccaug

SEQ ID NO: 3801 - RNA, 20 nt, Artificial Sequence
  Synthetic
aauuugcccuggaugguccu

SEQ ID NO: 3802 - RNA, 20 nt, Artificial Sequence
  Synthetic
ggcuggauucugacuacacu

SEQ ID NO: 3803 - RNA, 20 nt, Artificial Sequence
  Synthetic
cucuccugcgcaaaacgcuu

SEQ ID NO: 3804 - RNA, 20 nt, Artificial Sequence
  Synthetic
aucucggcucacaacaacuu

SEQ ID NO: 3805 - RNA, 20 nt, Artificial Sequence
  Synthetic
uuuugauaggcacaggaugg

SEQ ID NO: 3806 - RNA, 20 nt, Artificial Sequence
  Synthetic
aaaguggacagggcagggag

SEQ ID NO: 3807 - RNA, 20 nt, Artificial Sequence
  Synthetic
aagaggugaaaggaauucga

SEQ ID NO: 3808 - RNA, 20 nt, Artificial Sequence
  Synthetic
agaccaaaggcaaggggugu

SEQ ID NO: 3809 - RNA, 20 nt, Artificial Sequence
  Synthetic
aagguugcauuggacacugc

SEQ ID NO: 3810 - RNA, 20 nt, Artificial Sequence
  Synthetic
accacacugcugucucuccu

SEQ ID NO: 3811 - RNA, 20 nt, Artificial Sequence
  Synthetic
aauuaauaucguugauaaau

SEQ ID NO: 3812 - RNA, 20 nt, Artificial Sequence
  Synthetic
augcuauuaauaauucuguu

SEQ ID NO: 3813 - RNA, 20 nt, Artificial Sequence
  Synthetic
agggcaccauccagccuguc

SEQ ID NO: 3814 - RNA, 20 nt, Artificial Sequence
  Synthetic
ucauaggcuagugugugugu

SEQ ID NO: 3815 - RNA, 20 nt, Artificial Sequence
  Synthetic
gaagauggaaggucaguguu

SEQ ID NO: 3816 - RNA, 20 nt, Artificial Sequence
  Synthetic
cuggggguggagcccgaggc

SEQ ID NO: 3817 - RNA, 20 nt, Artificial Sequence
  Synthetic
uucugucccugugagaaggc

SEQ ID NO: 3818 - RNA, 20 nt, Artificial Sequence
  Synthetic
guaugucacugaagagaguc

SEQ ID NO: 3819 - RNA, 20 nt, Artificial Sequence
  Synthetic
agucgauccgugguugccca

SEQ ID NO: 3820 - RNA, 20 nt, Artificial Sequence
  Synthetic
cggcggaacgagguggaguu

SEQ ID NO: 3821 - RNA, 20 nt, Artificial Sequence
  Synthetic
uuguuuagaaauuauuuuau

SEQ ID NO: 3822 - RNA, 20 nt, Artificial Sequence
  Synthetic
gaggagaaauucugagcaga

SEQ ID NO: 3823 - RNA, 20 nt, Artificial Sequence
  Synthetic
aaacauuguguaugacggcg

SEQ ID NO: 3824 - RNA, 20 nt, Artificial Sequence
  Synthetic
uggagaaaacacaaggaagu

SEQ ID NO: 3825 - RNA, 20 nt, Artificial Sequence
  Synthetic
ugaagauggaaggucagugu

SEQ ID NO: 3826 - RNA, 20 nt, Artificial Sequence
  Synthetic
uuuaaaaauauugggugugg

SEQ ID NO: 3827 - RNA, 20 nt, Artificial Sequence
  Synthetic
uagaaggcuccucacagaac

SEQ ID NO: 3828 - RNA, 20 nt, Artificial Sequence
  Synthetic
gguguaacccaggaccaucc

SEQ ID NO: 3829 - RNA, 20 nt, Artificial Sequence
  Synthetic
uuucuugcugaggaaagagg

SEQ ID NO: 3830 - RNA, 20 nt, Artificial Sequence
  Synthetic
ucucuucuuugugauuggca

SEQ ID NO: 3831 - RNA, 20 nt, Artificial Sequence
  Synthetic
aaucgucugauugcuggaga

SEQ ID NO: 3832 - RNA, 20 nt, Artificial Sequence
  Synthetic
cauugcggugugaagaugga

SEQ ID NO: 3833 - RNA, 20 nt, Artificial Sequence
  Synthetic
ugucguggggugggggagcg

SEQ ID NO: 3834 - RNA, 20 nt, Artificial Sequence
  Synthetic
gcaagcuagugauacuggag

SEQ ID NO: 3835 - RNA, 20 nt, Artificial Sequence
  Synthetic
aguuuugauaggcacaggau

SEQ ID NO: 3836 - RNA, 20 nt, Artificial Sequence
  Synthetic
ucaccaugggcaugguccag

SEQ ID NO: 3837 - RNA, 20 nt, Artificial Sequence
  Synthetic
ggguacuugagaauugagag

SEQ ID NO: 3838 - RNA, 20 nt, Artificial Sequence
  Synthetic
uuucacuauuuuuccuuuag

SEQ ID NO: 3839 - RNA, 20 nt, Artificial Sequence
  Synthetic
ggaacagggacugguccuuu

SEQ ID NO: 3840 - RNA, 20 nt, Artificial Sequence
  Synthetic
uguguugggugggagugggu

SEQ ID NO: 3841 - RNA, 20 nt, Artificial Sequence
  Synthetic
acaagcggcuagaugucgag

SEQ ID NO: 3842 - RNA, 20 nt, Artificial Sequence
  Synthetic
gugaguaaccaguggaacaa

SEQ ID NO: 3843 - RNA, 20 nt, Artificial Sequence
  Synthetic
uucauccagauguuagaaau

SEQ ID NO: 3844 - RNA, 20 nt, Artificial Sequence
  Synthetic
cgucugauugcuggagaggg

SEQ ID NO: 3845 - RNA, 20 nt, Artificial Sequence
  Synthetic
gaggggggagacagggagaa

SEQ ID NO: 3846 - RNA, 20 nt, Artificial Sequence
  Synthetic
uccugcgcaaaacgcuuugg

SEQ ID NO: 3847 - RNA, 20 nt, Artificial Sequence
  Synthetic
aguuuaccaaucuuugugca

SEQ ID NO: 3848 - RNA, 20 nt, Artificial Sequence
  Synthetic
gcaucccucuggcccagggu

SEQ ID NO: 3849 - RNA, 20 nt, Artificial Sequence
  Synthetic
guguugggugggagugggug

SEQ ID NO: 3850 - RNA, 20 nt, Artificial Sequence
  Synthetic
gaggccccacccucucuccc

SEQ ID NO: 3851 - RNA, 20 nt, Artificial Sequence
  Synthetic
ucuaucgugcgcucuuccgc

SEQ ID NO: 3852 - RNA, 20 nt, Artificial Sequence
  Synthetic
ucauuaauuguugcaacuua

SEQ ID NO: 3853 - RNA, 20 nt, Artificial Sequence
  Synthetic
ccaauccaagagacuaaacu

SEQ ID NO: 3854 - RNA, 20 nt, Artificial Sequence
  Synthetic
gaacagggacugguccuuuu

SEQ ID NO: 3855 - RNA, 20 nt, Artificial Sequence
  Synthetic
gagacaagucucucuuuagc

SEQ ID NO: 3856 - RNA, 20 nt, Artificial Sequence
  Synthetic
ggugaguaaccaguggaaca

SEQ ID NO: 3857 - RNA, 20 nt, Artificial Sequence
  Synthetic
ugacccuuucucuccugaaa

SEQ ID NO: 3858 - RNA, 20 nt, Artificial Sequence
  Synthetic
ugagaaaguauggcauauuc

SEQ ID NO: 3859 - RNA, 20 nt, Artificial Sequence
  Synthetic
auuugucuguagacagccug

SEQ ID NO: 3860 - RNA, 20 nt, Artificial Sequence
  Synthetic
aagggggagcccagacaggc

SEQ ID NO: 3861 - RNA, 20 nt, Artificial Sequence
  Synthetic
cugaggcuggggcaacuggg

SEQ ID NO: 3862 - RNA, 20 nt, Artificial Sequence
  Synthetic
gacggaggcaagagacaguc

SEQ ID NO: 3863 - RNA, 20 nt, Artificial Sequence
  Synthetic
aagggcuguuuuuguuucua

SEQ ID NO: 3864 - RNA, 20 nt, Artificial Sequence
  Synthetic
gaacaacaguugucuuugug

SEQ ID NO: 3865 - RNA, 20 nt, Artificial Sequence
  Synthetic
aauccaacagaaaacaggau

SEQ ID NO: 3866 - RNA, 20 nt, Artificial Sequence
  Synthetic
cugacucaauuauaagacau

SEQ ID NO: 3867 - RNA, 20 nt, Artificial Sequence
  Synthetic
ccaugggaaggaacgcucua

SEQ ID NO: 3868 - RNA, 20 nt, Artificial Sequence
  Synthetic
cgcaggagaguggcggcauc

SEQ ID NO: 3869 - RNA, 20 nt, Artificial Sequence
  Synthetic
ggcaagcuagugauacugga

SEQ ID NO: 3870 - RNA, 20 nt, Artificial Sequence
  Synthetic
uuuaguuugccgucuguagg

SEQ ID NO: 3871 - RNA, 20 nt, Artificial Sequence
  Synthetic
auggaguuuuggugguguag

SEQ ID NO: 3872 - RNA, 20 nt, Artificial Sequence
  Synthetic
uguagcaaaguggacagggc

SEQ ID NO: 3873 - RNA, 20 nt, Artificial Sequence
  Synthetic
aaauaaugauuaucuuuuuu

SEQ ID NO: 3874 - RNA, 20 nt, Artificial Sequence
  Synthetic
gacccuuucucuccugaaau

SEQ ID NO: 3875 - RNA, 20 nt, Artificial Sequence
  Synthetic
gugaaagaaacggaagucug

SEQ ID NO: 3876 - RNA, 20 nt, Artificial Sequence
  Synthetic
gggugggggugugaaagaaa

SEQ ID NO: 3877 - RNA, 20 nt, Artificial Sequence
  Synthetic
gcaucauagggguguggaaa

SEQ ID NO: 3878 - RNA, 20 nt, Artificial Sequence
  Synthetic
aucuguguaaaagagacucc

SEQ ID NO: 3879 - RNA, 20 nt, Artificial Sequence
  Synthetic
ggcuaugcaggggcugcagu

SEQ ID NO: 3880 - RNA, 20 nt, Artificial Sequence
  Synthetic
aagucugggaaauggaguuu

SEQ ID NO: 3881 - RNA, 20 nt, Artificial Sequence
  Synthetic
ggaauucgauggcccauuuc

SEQ ID NO: 3882 - RNA, 20 nt, Artificial Sequence
  Synthetic
uuaucuuacuugcuuaacgc

SEQ ID NO: 3883 - RNA, 20 nt, Artificial Sequence
  Synthetic
gcugugaggcaguuucugaa

SEQ ID NO: 3884 - RNA, 20 nt, Artificial Sequence
  Synthetic
cggaugucucauguaacaug

SEQ ID NO: 3885 - RNA, 20 nt, Artificial Sequence
  Synthetic
gggcaccauccagccugucu

SEQ ID NO: 3886 - RNA, 20 nt, Artificial Sequence
  Synthetic
uuauaugcaucauaggggug

SEQ ID NO: 3887 - RNA, 20 nt, Artificial Sequence
  Synthetic
cuaccaucaaauauggcacc

SEQ ID NO: 3888 - RNA, 20 nt, Artificial Sequence
  Synthetic
uuauuguauuucuuguagag

SEQ ID NO: 3889 - RNA, 20 nt, Artificial Sequence
  Synthetic
ugcccccuagcagauaguca

SEQ ID NO: 3890 - RNA, 20 nt, Artificial Sequence
  Synthetic
uuucugcgggaggggagucu

SEQ ID NO: 3891 - RNA, 20 nt, Artificial Sequence
  Synthetic
uggcgggucccuguugccag

SEQ ID NO: 3892 - RNA, 20 nt, Artificial Sequence
  Synthetic
uuuguucaaaaugucuggga

SEQ ID NO: 3893 - RNA, 20 nt, Artificial Sequence
  Synthetic
uggcugggggcugcuagucc

SEQ ID NO: 3894 - RNA, 20 nt, Artificial Sequence
  Synthetic
ccagcucgauuucaacacug

SEQ ID NO: 3895 - RNA, 20 nt, Artificial Sequence
  Synthetic
caaacuccaccucguuccgc

SEQ ID NO: 3896 - RNA, 20 nt, Artificial Sequence
  Synthetic
ucuguguaaaagagacucca

SEQ ID NO: 3897 - RNA, 20 nt, Artificial Sequence
  Synthetic
guguaacccaggaccaucca

SEQ ID NO: 3898 - RNA, 20 nt, Artificial Sequence
  Synthetic
uaaauuaaaaagcagggaga

SEQ ID NO: 3899 - RNA, 20 nt, Artificial Sequence
  Synthetic
gcucuuaaaagaagggacca

SEQ ID NO: 3900 - RNA, 20 nt, Artificial Sequence
  Synthetic
ugugcccuacccugggccag

SEQ ID NO: 3901 - RNA, 20 nt, Artificial Sequence
  Synthetic
auuauaagacauaggaagcc

SEQ ID NO: 3902 - RNA, 20 nt, Artificial Sequence
  Synthetic
aaugaauuugagacgccuag

SEQ ID NO: 3903 - RNA, 20 nt, Artificial Sequence
  Synthetic
aaacacuuggagacagagcg

SEQ ID NO: 3904 - RNA, 20 nt, Artificial Sequence
  Synthetic
gucugcccaaugugcuauuc

SEQ ID NO: 3905 - RNA, 20 nt, Artificial Sequence
  Synthetic
ucaucccugacuaucugcua

SEQ ID NO: 3906 - RNA, 20 nt, Artificial Sequence
  Synthetic
agauaagaaauagagaaaag

SEQ ID NO: 3907 - RNA, 20 nt, Artificial Sequence
  Synthetic
aagaaguuggcugggugcag

SEQ ID NO: 3908 - RNA, 20 nt, Artificial Sequence
  Synthetic
gcaaacauuguguaugacgg

SEQ ID NO: 3909 - RNA, 20 nt, Artificial Sequence
  Synthetic
ggcccacguugcagggcacc

SEQ ID NO: 3910 - RNA, 20 nt, Artificial Sequence
  Synthetic
accuagaguccaaggaagag

SEQ ID NO: 3911 - RNA, 20 nt, Artificial Sequence
  Synthetic
gucuagaacuacaugccaca

SEQ ID NO: 3912 - RNA, 20 nt, Artificial Sequence
  Synthetic
uuuucuccuggagucgggcu

SEQ ID NO: 3913 - RNA, 20 nt, Artificial Sequence
  Synthetic
auuccuucccuccggguaua

SEQ ID NO: 3914 - RNA, 20 nt, Artificial Sequence
  Synthetic
caaacauuguguaugacggc

SEQ ID NO: 3915 - RNA, 20 nt, Artificial Sequence
  Synthetic
cuuucauaaccaaauccacu

SEQ ID NO: 3916 - RNA, 20 nt, Artificial Sequence
  Synthetic
ugucacagcaggaaauuuca

SEQ ID NO: 3917 - RNA, 20 nt, Artificial Sequence
  Synthetic
ccucagcucaccauuugcuc

SEQ ID NO: 3918 - RNA, 20 nt, Artificial Sequence
  Synthetic
ggugggaggaucaugagagu

SEQ ID NO: 3919 - RNA, 20 nt, Artificial Sequence
  Synthetic
ggacucagccccuggcaaca

SEQ ID NO: 3920 - RNA, 20 nt, Artificial Sequence
  Synthetic
uggggccucaaagcaggcag

SEQ ID NO: 3921 - RNA, 20 nt, Artificial Sequence
  Synthetic
cguggggugggggagcgggg

SEQ ID NO: 3922 - RNA, 20 nt, Artificial Sequence
  Synthetic
uucuauggccagcuucagga

SEQ ID NO: 3923 - RNA, 20 nt, Artificial Sequence
  Synthetic
aguaagauauuuuaauacga

SEQ ID NO: 3924 - RNA, 20 nt, Artificial Sequence
  Synthetic
acugaaaaggccagagcaaa

SEQ ID NO: 3925 - RNA, 20 nt, Artificial Sequence
  Synthetic
cugguggccauaggauggua

SEQ ID NO: 3926 - RNA, 20 nt, Artificial Sequence
  Synthetic
gagaaaagaggccaggugca

SEQ ID NO: 3927 - RNA, 20 nt, Artificial Sequence
  Synthetic
ucuuuuaguuugccgucugu

SEQ ID NO: 3928 - RNA, 20 nt, Artificial Sequence
  Synthetic
ugguacuuauacuuugauug

SEQ ID NO: 3929 - RNA, 20 nt, Artificial Sequence
  Synthetic
cuuucugcgggaggggaguc

SEQ ID NO: 3930 - RNA, 20 nt, Artificial Sequence
  Synthetic
uaaugaauuugagacgccua

SEQ ID NO: 3931 - RNA, 20 nt, Artificial Sequence
  Synthetic
ucacugccucagcagcgugg

SEQ ID NO: 3932 - RNA, 20 nt, Artificial Sequence
  Synthetic
aaaaaaagugguugcagaac

SEQ ID NO: 3933 - RNA, 20 nt, Artificial Sequence
  Synthetic
ucugggaaggccgggugugg

SEQ ID NO: 3934 - RNA, 20 nt, Artificial Sequence
  Synthetic
ccagccaaaaauagccagug

SEQ ID NO: 3935 - RNA, 20 nt, Artificial Sequence
  Synthetic
ccacacuggcuauuuuuggc

SEQ ID NO: 3936 - RNA, 20 nt, Artificial Sequence
  Synthetic
caauuagggucuaguuggcu

SEQ ID NO: 3937 - RNA, 20 nt, Artificial Sequence
  Synthetic
ugccagcucgauuucaacac

SEQ ID NO: 3938 - RNA, 20 nt, Artificial Sequence
  Synthetic
gagcuagcaagagacaucua

SEQ ID NO: 3939 - RNA, 20 nt, Artificial Sequence
  Synthetic
acuuuuuuuguguccacugu

SEQ ID NO: 3940 - RNA, 20 nt, Artificial Sequence
  Synthetic
uuaaauagcaaagugguuaa

SEQ ID NO: 3941 - RNA, 20 nt, Artificial Sequence
  Synthetic
ugaggaaagaggagggggca

SEQ ID NO: 3942 - RNA, 20 nt, Artificial Sequence
  Synthetic
ggggccucaaagcaggcagu

SEQ ID NO: 3943 - RNA, 20 nt, Artificial Sequence
  Synthetic
auagcaaagugguuaaagga

SEQ ID NO: 3944 - RNA, 20 nt, Artificial Sequence
  Synthetic
auuguauuucuuguagagag

SEQ ID NO: 3945 - RNA, 20 nt, Artificial Sequence
  Synthetic
agggcuucccuaagcccaaa

SEQ ID NO: 3946 - RNA, 20 nt, Artificial Sequence
  Synthetic
caggcugucggagaagagug

SEQ ID NO: 3947 - RNA, 20 nt, Artificial Sequence
  Synthetic
uucaaaaugucugggaaggc

SEQ ID NO: 3948 - RNA, 20 nt, Artificial Sequence
  Synthetic
ugauguugaccuaacugaca

SEQ ID NO: 3949 - RNA, 20 nt, Artificial Sequence
  Synthetic
aaucuaagauuggugacugg

SEQ ID NO: 3950 - RNA, 20 nt, Artificial Sequence
  Synthetic
ccauuugcggggcgggcgga

SEQ ID NO: 3951 - RNA, 20 nt, Artificial Sequence
  Synthetic
aguacuucgaugggcuaugc

SEQ ID NO: 3952 - RNA, 20 nt, Artificial Sequence
  Synthetic
gguuguuagacucagcacug

SEQ ID NO: 3953 - RNA, 20 nt, Artificial Sequence
  Synthetic
ccucucgugaaagagaaaga

SEQ ID NO: 3954 - RNA, 20 nt, Artificial Sequence
  Synthetic
agguagaguaccugggagag

SEQ ID NO: 3955 - RNA, 20 nt, Artificial Sequence
  Synthetic
agcuagcaagagacaucuac

SEQ ID NO: 3956 - RNA, 20 nt, Artificial Sequence
  Synthetic
gacagcagugugguggcugc

SEQ ID NO: 3957 - RNA, 20 nt, Artificial Sequence
  Synthetic
ugagacaggccgaucacuug

SEQ ID NO: 3958 - RNA, 20 nt, Artificial Sequence
  Synthetic
ugacuacuuuaagaugcuuu

SEQ ID NO: 3959 - RNA, 20 nt, Artificial Sequence
  Synthetic
uugcccccuagcagauaguc

SEQ ID NO: 3960 - RNA, 20 nt, Artificial Sequence
  Synthetic
aacguccucuuuauagggaa

SEQ ID NO: 3961 - RNA, 20 nt, Artificial Sequence
  Synthetic
cucaguuuccuugugugucc

SEQ ID NO: 3962 - RNA, 20 nt, Artificial Sequence
  Synthetic
uuccuuucaagugcuguuaa

SEQ ID NO: 3963 - RNA, 20 nt, Artificial Sequence
  Synthetic
caaaacuccaagacccuagc

SEQ ID NO: 3964 - RNA, 20 nt, Artificial Sequence
  Synthetic
ccaggcugucggagaagagu

SEQ ID NO: 3965 - RNA, 20 nt, Artificial Sequence
  Synthetic
ggguggcccugaaucuuccu

SEQ ID NO: 3966 - RNA, 20 nt, Artificial Sequence
  Synthetic
agccucacucucugcucaca

SEQ ID NO: 3967 - RNA, 20 nt, Artificial Sequence
  Synthetic
uauuuccauuuuuuacacuc

SEQ ID NO: 3968 - RNA, 20 nt, Artificial Sequence
  Synthetic
uuuuuguuauuacuucucuu

SEQ ID NO: 3969 - RNA, 20 nt, Artificial Sequence
  Synthetic
gauggcuuuccaguucugug

SEQ ID NO: 3970 - RNA, 20 nt, Artificial Sequence
  Synthetic
uucuucgcaucgcgggggug

SEQ ID NO: 3971 - RNA, 20 nt, Artificial Sequence
  Synthetic
acgauguucucugcucuucg

SEQ ID NO: 3972 - RNA, 20 nt, Artificial Sequence
  Synthetic
cuucaucuguuuccauggga

SEQ ID NO: 3973 - RNA, 20 nt, Artificial Sequence
  Synthetic
ucaacacugggguguccccu

SEQ ID NO: 3974 - RNA, 20 nt, Artificial Sequence
  Synthetic
gggucuaugcuauguuaccc

SEQ ID NO: 3975 - RNA, 20 nt, Artificial Sequence
  Synthetic
agaguaccugggagagaggg

SEQ ID NO: 3976 - RNA, 20 nt, Artificial Sequence
  Synthetic
aggagccuucuaaaguucaa

SEQ ID NO: 3977 - RNA, 20 nt, Artificial Sequence
  Synthetic
gcuucaauuaggaaaaaaua

SEQ ID NO: 3978 - RNA, 20 nt, Artificial Sequence
  Synthetic
auaaaucuaagauuggugac

SEQ ID NO: 3979 - RNA, 20 nt, Artificial Sequence
  Synthetic
acucaagggggagcccagac

SEQ ID NO: 3980 - RNA, 20 nt, Artificial Sequence
  Synthetic
guggaacuugaggauagacg

SEQ ID NO: 3981 - RNA, 20 nt, Artificial Sequence
  Synthetic
guagcaaaguggacagggca

SEQ ID NO: 3982 - RNA, 20 nt, Artificial Sequence
  Synthetic
aggagaaauucugagcagau

SEQ ID NO: 3983 - RNA, 20 nt, Artificial Sequence
  Synthetic
aauaauaaaguguccuucaa

SEQ ID NO: 3984 - RNA, 20 nt, Artificial Sequence
  Synthetic
uuggcgggucccuguugcca

SEQ ID NO: 3985 - RNA, 20 nt, Artificial Sequence
  Synthetic
aacaguugucuuugugugga

SEQ ID NO: 3986 - RNA, 20 nt, Artificial Sequence
  Synthetic
cuacagacaaaugcuuucug

SEQ ID NO: 3987 - RNA, 20 nt, Artificial Sequence
  Synthetic
uguaggcuuggcgcuauacu

SEQ ID NO: 3988 - RNA, 20 nt, Artificial Sequence
  Synthetic
uuguggcacagugagggaac

SEQ ID NO: 3989 - RNA, 20 nt, Artificial Sequence
  Synthetic
cuuaaaguagucagaguuac

SEQ ID NO: 3990 - RNA, 20 nt, Artificial Sequence
  Synthetic
cuuguagucccagcuaccau

SEQ ID NO: 3991 - RNA, 20 nt, Artificial Sequence
  Synthetic
gagcgaggaacaucacacac

SEQ ID NO: 3992 - RNA, 20 nt, Artificial Sequence
  Synthetic
cuccagggagcuagugaaac

SEQ ID NO: 3993 - RNA, 20 nt, Artificial Sequence
  Synthetic
cuccuguuucucaagcagau

SEQ ID NO: 3994 - RNA, 20 nt, Artificial Sequence
  Synthetic
ggcgcgcuuuagauacacac

SEQ ID NO: 3995 - RNA, 20 nt, Artificial Sequence
  Synthetic
cauaggcuaguguguguguu

SEQ ID NO: 3996 - RNA, 20 nt, Artificial Sequence
  Synthetic
uagaacuacaugccacaggg

SEQ ID NO: 3997 - RNA, 20 nt, Artificial Sequence
  Synthetic
caucucagggcaugcaaggg

SEQ ID NO: 3998 - RNA, 20 nt, Artificial Sequence
  Synthetic
cggaaugcuauugacggugg

SEQ ID NO: 3999 - RNA, 20 nt, Artificial Sequence
  Synthetic
uucgcaucgcgggggugggg

SEQ ID NO: 4000 - RNA, 20 nt, Artificial Sequence
  Synthetic
aucagcaauuagggucuagu

SEQ ID NO: 4001 - RNA, 20 nt, Artificial Sequence
  Synthetic
auuugcggggcgggcggaag

SEQ ID NO: 4002 - RNA, 20 nt, Artificial Sequence
  Synthetic
gguggaagcuaaaggaagau

SEQ ID NO: 4003 - RNA, 20 nt, Artificial Sequence
  Synthetic
acuucuucgcaucgcggggg

SEQ ID NO: 4004 - RNA, 20 nt, Artificial Sequence
  Synthetic
cuccucauuacagugaaaua

SEQ ID NO: 4005 - RNA, 20 nt, Artificial Sequence
  Synthetic
ggagaaaagcaucucccuuc

SEQ ID NO: 4006 - RNA, 20 nt, Artificial Sequence
  Synthetic
uggugauuaaaucauugugu

SEQ ID NO: 4007 - RNA, 20 nt, Artificial Sequence
  Synthetic
uuuuauaauugugaugauaa

SEQ ID NO: 4008 - RNA, 20 nt, Artificial Sequence
  Synthetic
auuuaaauuccaauaccaca

SEQ ID NO: 4009 - RNA, 20 nt, Artificial Sequence
  Synthetic
ugauuguguccucugucccc

SEQ ID NO: 4010 - RNA, 20 nt, Artificial Sequence
  Synthetic
auaaugaauuugagacgccu

SEQ ID NO: 4011 - RNA, 20 nt, Artificial Sequence
  Synthetic
ugagaaacauaaaucccgag

SEQ ID NO: 4012 - RNA, 20 nt, Artificial Sequence
  Synthetic
gugcccuacccugggccaga

SEQ ID NO: 4013 - RNA, 20 nt, Artificial Sequence
  Synthetic
ugaaaugaacuguccagaac

SEQ ID NO: 4014 - RNA, 20 nt, Artificial Sequence
  Synthetic
ccauagagcguuccuuccca

SEQ ID NO: 4015 - RNA, 20 nt, Artificial Sequence
  Synthetic
augucucauguaacaugugg

SEQ ID NO: 4016 - RNA, 20 nt, Artificial Sequence
  Synthetic
uauuauuauaugcaucauag

SEQ ID NO: 4017 - RNA, 20 nt, Artificial Sequence
  Synthetic
agagaaaagaggccaggugc

SEQ ID NO: 4018 - RNA, 20 nt, Artificial Sequence
  Synthetic
agcaauguuuacuggguggg

SEQ ID NO: 4019 - RNA, 20 nt, Artificial Sequence
  Synthetic
caguguugggaagaguccau

SEQ ID NO: 4020 - RNA, 20 nt, Artificial Sequence
  Synthetic
ugggacgacagguguaaccc

SEQ ID NO: 4021 - RNA, 20 nt, Artificial Sequence
  Synthetic
uucaaagauugagagggaau

SEQ ID NO: 4022 - RNA, 20 nt, Artificial Sequence
  Synthetic
gggccagagggaugcuccag

SEQ ID NO: 4023 - RNA, 20 nt, Artificial Sequence
  Synthetic
cauuugcggggcgggcggaa

SEQ ID NO: 4024 - RNA, 20 nt, Artificial Sequence
  Synthetic
cacugcuaggguuaaaugaa

SEQ ID NO: 4025 - RNA, 20 nt, Artificial Sequence
  Synthetic
aauacacauagaaaaaugac

SEQ ID NO: 4026 - RNA, 20 nt, Artificial Sequence
  Synthetic
agacccauccuguuuucugu

SEQ ID NO: 4027 - RNA, 20 nt, Artificial Sequence
  Synthetic
cuaugcuauguuacccaggc

SEQ ID NO: 4028 - RNA, 20 nt, Artificial Sequence
  Synthetic
uugcuggugggggugcaagg

SEQ ID NO: 4029 - RNA, 20 nt, Artificial Sequence
  Synthetic
cacugguuacucacccgcua

SEQ ID NO: 4030 - RNA, 20 nt, Artificial Sequence
  Synthetic
caccacacugcugucucucc

SEQ ID NO: 4031 - RNA, 20 nt, Artificial Sequence
  Synthetic
gggacuagucaugacuacau

SEQ ID NO: 4032 - RNA, 20 nt, Artificial Sequence
  Synthetic
uuauuagauuccagugguac

SEQ ID NO: 4033 - RNA, 20 nt, Artificial Sequence
  Synthetic
cuacuuagaaauauaccuug

SEQ ID NO: 4034 - RNA, 20 nt, Artificial Sequence
  Synthetic
ucgaacaauagacuuucaau

SEQ ID NO: 4035 - RNA, 20 nt, Artificial Sequence
  Synthetic
gacagggagaauggggagcg

SEQ ID NO: 4036 - RNA, 20 nt, Artificial Sequence
  Synthetic
ccaacaucaccuucucagug

SEQ ID NO: 4037 - RNA, 20 nt, Artificial Sequence
  Synthetic
ccucaaagcaggcaguggga

SEQ ID NO: 4038 - RNA, 20 nt, Artificial Sequence
  Synthetic
aucgggguauguuuacacaa

SEQ ID NO: 4039 - RNA, 20 nt, Artificial Sequence
  Synthetic
uuucguacaauacuggaggc

SEQ ID NO: 4040 - RNA, 20 nt, Artificial Sequence
  Synthetic
uucgccccuagacacugccg

SEQ ID NO: 4041 - RNA, 20 nt, Artificial Sequence
  Synthetic
ugcccugagauggggacaag

SEQ ID NO: 4042 - RNA, 20 nt, Artificial Sequence
  Synthetic
gggagcuagugaaacaggaa

SEQ ID NO: 4043 - RNA, 20 nt, Artificial Sequence
  Synthetic
aaucuuaaaucaucuaauug

SEQ ID NO: 4044 - RNA, 20 nt, Artificial Sequence
  Synthetic
aaauccaacagaaaacagga

SEQ ID NO: 4045 - RNA, 20 nt, Artificial Sequence
  Synthetic
auguaaaccaguugucuguu

SEQ ID NO: 4046 - RNA, 20 nt, Artificial Sequence
  Synthetic
accaaauccacuuggcucaa

SEQ ID NO: 4047 - RNA, 20 nt, Artificial Sequence
  Synthetic
aucgaacaauagacuuucaa

SEQ ID NO: 4048 - RNA, 20 nt, Artificial Sequence
  Synthetic
aggcuaguguguguguuggg

SEQ ID NO: 4049 - RNA, 20 nt, Artificial Sequence
  Synthetic
gggacucagccccuggcaac

SEQ ID NO: 4050 - RNA, 20 nt, Artificial Sequence
  Synthetic
uuuggcgggucccuguugcc

SEQ ID NO: 4051 - RNA, 20 nt, Artificial Sequence
  Synthetic
uuagcugagcguggcagcgc

SEQ ID NO: 4052 - RNA, 20 nt, Artificial Sequence
  Synthetic
agucuagaacuacaugccac

SEQ ID NO: 4053 - RNA, 20 nt, Artificial Sequence
  Synthetic
ugucgagaggagcacauugg

SEQ ID NO: 4054 - RNA, 20 nt, Artificial Sequence
  Synthetic
ugugguaguaguaagaugug

SEQ ID NO: 4055 - RNA, 20 nt, Artificial Sequence
  Synthetic
acugcuaggguuaaaugaaa

SEQ ID NO: 4056 - RNA, 20 nt, Artificial Sequence
  Synthetic
aaaaaauccuaacagacaac

SEQ ID NO: 4057 - RNA, 20 nt, Artificial Sequence
  Synthetic
uguggcacagugagggaacu

SEQ ID NO: 4058 - RNA, 20 nt, Artificial Sequence
  Synthetic
uaauuaaaauuggccgggcg

SEQ ID NO: 4059 - RNA, 20 nt, Artificial Sequence
  Synthetic
ccaaaccggaaugcuauuga

SEQ ID NO: 4060 - RNA, 20 nt, Artificial Sequence
  Synthetic
ucuauuucuuaucuccugag

SEQ ID NO: 4061 - RNA, 20 nt, Artificial Sequence
  Synthetic
ucugucccugugagaaggca

SEQ ID NO: 4062 - RNA, 20 nt, Artificial Sequence
  Synthetic
cucggcuucaucuguuucca

SEQ ID NO: 4063 - RNA, 20 nt, Artificial Sequence
  Synthetic
gagaguuggaggcugcagug

SEQ ID NO: 4064 - RNA, 20 nt, Artificial Sequence
  Synthetic
uaaaagagaaaccuugggcc

SEQ ID NO: 4065 - RNA, 20 nt, Artificial Sequence
  Synthetic
uauuccuucccuccggguau

SEQ ID NO: 4066 - RNA, 20 nt, Artificial Sequence
  Synthetic
ccaagguauauuucuaagua

SEQ ID NO: 4067 - RNA, 20 nt, Artificial Sequence
  Synthetic
caaaaauagccaguguggcu

SEQ ID NO: 4068 - RNA, 20 nt, Artificial Sequence
  Synthetic
acagggagaauggggagcga

SEQ ID NO: 4069 - RNA, 20 nt, Artificial Sequence
  Synthetic
aauauugggugugguggcac

SEQ ID NO: 4070 - RNA, 20 nt, Artificial Sequence
  Synthetic
uuccuguuucacuagcuccc

SEQ ID NO: 4071 - RNA, 20 nt, Artificial Sequence
  Synthetic
aaguaccauauacauaaugu

SEQ ID NO: 4072 - RNA, 20 nt, Artificial Sequence
  Synthetic
aaauuaugaaugauuaaaaa

SEQ ID NO: 4073 - RNA, 20 nt, Artificial Sequence
  Synthetic
uucguacaauacuggaggcu

SEQ ID NO: 4074 - RNA, 20 nt, Artificial Sequence
  Synthetic
auaaaagagaaaccuugggc

SEQ ID NO: 4075 - RNA, 20 nt, Artificial Sequence
  Synthetic
uguuuuuuauuagauuccag

SEQ ID NO: 4076 - RNA, 20 nt, Artificial Sequence
  Synthetic
ccuacuuagaaauauaccuu

SEQ ID NO: 4077 - RNA, 20 nt, Artificial Sequence
  Synthetic
gcagagaacaucgucucucc

SEQ ID NO: 4078 - RNA, 20 nt, Artificial Sequence
  Synthetic
uguccccuggagcaucccuc

SEQ ID NO: 4079 - RNA, 20 nt, Artificial Sequence
  Synthetic
cucuaaagauuugccaguuc

SEQ ID NO: 4080 - RNA, 20 nt, Artificial Sequence
  Synthetic
uucucaagcagauuggaagc

SEQ ID NO: 4081 - RNA, 20 nt, Artificial Sequence
  Synthetic
gguagaguaccugggagaga

SEQ ID NO: 4082 - RNA, 20 nt, Artificial Sequence
  Synthetic
ccagggaugaagcaggaagc

SEQ ID NO: 4083 - RNA, 20 nt, Artificial Sequence
  Synthetic
ccaaacccacggcagugucu

SEQ ID NO: 4084 - RNA, 20 nt, Artificial Sequence
  Synthetic
caggagagacagcagugugg

SEQ ID NO: 4085 - RNA, 20 nt, Artificial Sequence
  Synthetic
gccucacucucugcucacaa

SEQ ID NO: 4086 - RNA, 20 nt, Artificial Sequence
  Synthetic
gaaaaaugacaggaaaugac

SEQ ID NO: 4087 - RNA, 20 nt, Artificial Sequence
  Synthetic
caagccacacuggcuauuuu

SEQ ID NO: 4088 - RNA, 20 nt, Artificial Sequence
  Synthetic
ucggaugacugcacucaccu

SEQ ID NO: 4089 - RNA, 20 nt, Artificial Sequence
  Synthetic
aguagguugccaagccacac

SEQ ID NO: 4090 - RNA, 20 nt, Artificial Sequence
  Synthetic
acucucuucagugacauaca

SEQ ID NO: 4091 - RNA, 20 nt, Artificial Sequence
  Synthetic
aaaagggccacucugcugug

SEQ ID NO: 4092 - RNA, 20 nt, Artificial Sequence
  Synthetic
auguuggagcaaagauucga

SEQ ID NO: 4093 - RNA, 20 nt, Artificial Sequence
  Synthetic
caacaucaccuucucaguga

SEQ ID NO: 4094 - RNA, 20 nt, Artificial Sequence
  Synthetic
uaauaauaaaguguccuuca

SEQ ID NO: 4095 - RNA, 20 nt, Artificial Sequence
  Synthetic
aaaaaagugguugcagaaca

SEQ ID NO: 4096 - RNA, 20 nt, Artificial Sequence
  Synthetic
aauggaguuuugguggugua

SEQ ID NO: 4097 - RNA, 20 nt, Artificial Sequence
  Synthetic
uuaaaguagucagaguuacu

SEQ ID NO: 4098 - RNA, 20 nt, Artificial Sequence
  Synthetic
ggucuaauuuuaaaaugcuu

SEQ ID NO: 4099 - RNA, 20 nt, Artificial Sequence
  Synthetic
uaaaugagaaaagcauaaca

SEQ ID NO: 4100 - RNA, 20 nt, Artificial Sequence
  Synthetic
aauuagggucuaguuggcug

SEQ ID NO: 4101 - RNA, 20 nt, Artificial Sequence
  Synthetic
gggagcgagggcuuaauguu

SEQ ID NO: 4102 - RNA, 20 nt, Artificial Sequence
  Synthetic
ugucuuucgcuuagcauaug

SEQ ID NO: 4103 - RNA, 20 nt, Artificial Sequence
  Synthetic
uuggagcaaagauucgaagg

SEQ ID NO: 4104 - RNA, 20 nt, Artificial Sequence
  Synthetic
uuaacacaauuagcugagcg

SEQ ID NO: 4105 - RNA, 20 nt, Artificial Sequence
  Synthetic
uuguacgaaauaaauuucug

SEQ ID NO: 4106 - RNA, 20 nt, Artificial Sequence
  Synthetic
gaaagcaggccucucuuccu

SEQ ID NO: 4107 - RNA, 20 nt, Artificial Sequence
  Synthetic
caugagaugcauccacccug

SEQ ID NO: 4108 - RNA, 20 nt, Artificial Sequence
  Synthetic
ucagcacuguggaagaaaca

SEQ ID NO: 4109 - RNA, 20 nt, Artificial Sequence
  Synthetic
cuucuucgcaucgcgggggu

SEQ ID NO: 4110 - RNA, 20 nt, Artificial Sequence
  Synthetic
aaccaguggaacaagggccc

SEQ ID NO: 4111 - RNA, 20 nt, Artificial Sequence
  Synthetic
cuucccuccggguauagggc

SEQ ID NO: 4112 - RNA, 20 nt, Artificial Sequence
  Synthetic
aucccugacuaucugcuagg

SEQ ID NO: 4113 - RNA, 20 nt, Artificial Sequence
  Synthetic
ucggcuucaucuguuuccau

SEQ ID NO: 4114 - RNA, 20 nt, Artificial Sequence
  Synthetic
aggcaaagaaauucuaugga

SEQ ID NO: 4115 - RNA, 20 nt, Artificial Sequence
  Synthetic
ccugguggccauaggauggu

SEQ ID NO: 4116 - RNA, 20 nt, Artificial Sequence
  Synthetic
cagcgcguggucccugccuc

SEQ ID NO: 4117 - RNA, 20 nt, Artificial Sequence
  Synthetic
uggggguggagcccgaggca

SEQ ID NO: 4118 - RNA, 20 nt, Artificial Sequence
  Synthetic
gagaaaccuugggccgggca

SEQ ID NO: 4119 - RNA, 20 nt, Artificial Sequence
  Synthetic
cugacuacuuuaagaugcuu

SEQ ID NO: 4120 - RNA, 20 nt, Artificial Sequence
  Synthetic
gauggauggcgaagccacuc

SEQ ID NO: 4121 - RNA, 20 nt, Artificial Sequence
  Synthetic
gcuuuggugguaaaaaauac

SEQ ID NO: 4122 - RNA, 20 nt, Artificial Sequence
  Synthetic
cccaagguauauuucuaagu

SEQ ID NO: 4123 - RNA, 20 nt, Artificial Sequence
  Synthetic
ggcuaguguguguguugggu

SEQ ID NO: 4124 - RNA, 20 nt, Artificial Sequence
  Synthetic
ccucagccucccaugguagc

SEQ ID NO: 4125 - RNA, 20 nt, Artificial Sequence
  Synthetic
gcagcgcguggucccugccu

SEQ ID NO: 4126 - RNA, 20 nt, Artificial Sequence
  Synthetic
uauuagauuccagugguacu

SEQ ID NO: 4127 - RNA, 20 nt, Artificial Sequence
  Synthetic
gaaaaccuaguuuagucucu

SEQ ID NO: 4128 - RNA, 20 nt, Artificial Sequence
  Synthetic
cuggagucgggcuugguagg

SEQ ID NO: 4129 - RNA, 20 nt, Artificial Sequence
  Synthetic
auuaauuaaaauuggccggg

SEQ ID NO: 4130 - RNA, 20 nt, Artificial Sequence
  Synthetic
agauucauucauucauuccu

SEQ ID NO: 4131 - RNA, 20 nt, Artificial Sequence
  Synthetic
uucacuuaggcguuggauga

SEQ ID NO: 4132 - RNA, 20 nt, Artificial Sequence
  Synthetic
uuugaggcaaagaaauucua

SEQ ID NO: 4133 - RNA, 20 nt, Artificial Sequence
  Synthetic
gagacagucuggcacauuug

SEQ ID NO: 4134 - RNA, 20 nt, Artificial Sequence
  Synthetic
cucagccucccaugguagcu

SEQ ID NO: 4135 - RNA, 20 nt, Artificial Sequence
  Synthetic
cucccuugcaugcccugaga

SEQ ID NO: 4136 - RNA, 20 nt, Artificial Sequence
  Synthetic
uuaauuaaaauuggccgggc

SEQ ID NO: 4137 - RNA, 20 nt, Artificial Sequence
  Synthetic
uagucaugacuagucccaug

SEQ ID NO: 4138 - RNA, 20 nt, Artificial Sequence
  Synthetic
uagucacauuucucaguauu

SEQ ID NO: 4139 - RNA, 20 nt, Artificial Sequence
  Synthetic
ugaggagacacugccacuga

SEQ ID NO: 4140 - RNA, 20 nt, Artificial Sequence
  Synthetic
cugagcaaaccuagagucca

SEQ ID NO: 4141 - RNA, 20 nt, Artificial Sequence
  Synthetic
agcuucaggagggagggggc

SEQ ID NO: 4142 - RNA, 20 nt, Artificial Sequence
  Synthetic
aacguuucuaucaucgcaga

SEQ ID NO: 4143 - RNA, 20 nt, Artificial Sequence
  Synthetic
uguaugacggcggggcgcgg

SEQ ID NO: 4144 - RNA, 20 nt, Artificial Sequence
  Synthetic
ugggccagagggaugcucca

SEQ ID NO: 4145 - RNA, 20 nt, Artificial Sequence
  Synthetic
auuagggucuaguuggcugg

SEQ ID NO: 4146 - RNA, 20 nt, Artificial Sequence
  Synthetic
agaaaaaugacaggaaauga

SEQ ID NO: 4147 - RNA, 20 nt, Artificial Sequence
  Synthetic
gugugauauuccuucccucc

SEQ ID NO: 4148 - RNA, 20 nt, Artificial Sequence
  Synthetic
uuguguaugacggcggggcg

SEQ ID NO: 4149 - RNA, 20 nt, Artificial Sequence
  Synthetic
ccaaucuuugugcauggcug

SEQ ID NO: 4150 - RNA, 20 nt, Artificial Sequence
  Synthetic
ugcaaaggaaaucagcaauu

SEQ ID NO: 4151 - RNA, 20 nt, Artificial Sequence
  Synthetic
agaaagccccugguggccau

SEQ ID NO: 4152 - RNA, 20 nt, Artificial Sequence
  Synthetic
gcuauuaaaaaggaugaggu

SEQ ID NO: 4153 - RNA, 20 nt, Artificial Sequence
  Synthetic
uauggccagcuucaggaggg

SEQ ID NO: 4154 - RNA, 20 nt, Artificial Sequence
  Synthetic
uuaucagucauuuuuuguau

SEQ ID NO: 4155 - RNA, 20 nt, Artificial Sequence
  Synthetic
ccauaggaugguagggauuu

SEQ ID NO: 4156 - RNA, 20 nt, Artificial Sequence
  Synthetic
ccacugaaggacagaagcag

SEQ ID NO: 4157 - RNA, 20 nt, Artificial Sequence
  Synthetic
aggguuuccucacagcagag

SEQ ID NO: 4158 - RNA, 20 nt, Artificial Sequence
  Synthetic
gccagcucgauuucaacacu

SEQ ID NO: 4159 - RNA, 20 nt, Artificial Sequence
  Synthetic
aaguuccacaaagccucaca

SEQ ID NO: 4160 - RNA, 20 nt, Artificial Sequence
  Synthetic
auuaucagucauuuuuugua

SEQ ID NO: 4161 - RNA, 20 nt, Artificial Sequence
  Synthetic
cuaucuccaugaccccuuga

SEQ ID NO: 4162 - RNA, 20 nt, Artificial Sequence
  Synthetic
gacuacuuuaagaugcuuug

SEQ ID NO: 4163 - RNA, 20 nt, Artificial Sequence
  Synthetic
gacugguccuuuugggcuua

SEQ ID NO: 4164 - RNA, 20 nt, Artificial Sequence
  Synthetic
augugguaguaguaagaugu

SEQ ID NO: 4165 - RNA, 20 nt, Artificial Sequence
  Synthetic
uacauggccuuugagccaag

SEQ ID NO: 4166 - RNA, 20 nt, Artificial Sequence
  Synthetic
caucaaccggcggaacgagg

SEQ ID NO: 4167 - RNA, 20 nt, Artificial Sequence
  Synthetic
ggacugguccuuuugggcuu

SEQ ID NO: 4168 - RNA, 20 nt, Artificial Sequence
  Synthetic
ugguguaucugcuucagcau

SEQ ID NO: 4169 - RNA, 20 nt, Artificial Sequence
  Synthetic
aaauauugggugugguggca

SEQ ID NO: 4170 - RNA, 20 nt, Artificial Sequence
  Synthetic
gaaacauaaaucccgagagg

SEQ ID NO: 4171 - RNA, 20 nt, Artificial Sequence
  Synthetic
cuaccuccugcccaccucuc

SEQ ID NO: 4172 - RNA, 20 nt, Artificial Sequence
  Synthetic
agaugucgagaggagcacau

SEQ ID NO: 4173 - RNA, 20 nt, Artificial Sequence
  Synthetic
cucuguaacacacgccugcu

SEQ ID NO: 4174 - RNA, 20 nt, Artificial Sequence
  Synthetic
cugggccagagggaugcucc

SEQ ID NO: 4175 - RNA, 20 nt, Artificial Sequence
  Synthetic
aaaauagguuuaaaaauauu

SEQ ID NO: 4176 - RNA, 20 nt, Artificial Sequence
  Synthetic
aaaccuugggccgggcaugg

SEQ ID NO: 4177 - RNA, 20 nt, Artificial Sequence
  Synthetic
cagagcaaauggugagcuga

SEQ ID NO: 4178 - RNA, 20 nt, Artificial Sequence
  Synthetic
accuucauugcuacuugaga

SEQ ID NO: 4179 - RNA, 20 nt, Artificial Sequence
  Synthetic
cuaguuuagucucuuggauu

SEQ ID NO: 4180 - RNA, 20 nt, Artificial Sequence
  Synthetic
agucuggcacauuuguggcu

SEQ ID NO: 4181 - RNA, 20 nt, Artificial Sequence
  Synthetic
acauaugagcauuuccaguu

SEQ ID NO: 4182 - RNA, 20 nt, Artificial Sequence
  Synthetic
cccuacuuagaaauauaccu

SEQ ID NO: 4183 - RNA, 20 nt, Artificial Sequence
  Synthetic
auaugguaccucagaacccc

SEQ ID NO: 4184 - RNA, 20 nt, Artificial Sequence
  Synthetic
gaaacccuuguugucacagc

SEQ ID NO: 4185 - RNA, 20 nt, Artificial Sequence
  Synthetic
ugguggaagcuaaaggaaga

SEQ ID NO: 4186 - RNA, 20 nt, Artificial Sequence
  Synthetic
cauaugagcauuuccaguuu

SEQ ID NO: 4187 - RNA, 20 nt, Artificial Sequence
  Synthetic
ucgccccuagacacugccgu

SEQ ID NO: 4188 - RNA, 20 nt, Artificial Sequence
  Synthetic
caucccugacuaucugcuag

SEQ ID NO: 4189 - RNA, 20 nt, Artificial Sequence
  Synthetic
gcaaaggaaaucagcaauua

SEQ ID NO: 4190 - RNA, 20 nt, Artificial Sequence
  Synthetic
ccagagcaaauggugagcug

SEQ ID NO: 4191 - RNA, 20 nt, Artificial Sequence
  Synthetic
uuuguuuuguucaaaauguc

SEQ ID NO: 4192 - RNA, 20 nt, Artificial Sequence
  Synthetic
guguccugcccuauacccgg

SEQ ID NO: 4193 - RNA, 20 nt, Artificial Sequence
  Synthetic
guagacagccugggguucug

SEQ ID NO: 4194 - RNA, 20 nt, Artificial Sequence
  Synthetic
uaauuuuaugcuuuucuucu

SEQ ID NO: 4195 - RNA, 20 nt, Artificial Sequence
  Synthetic
ccccaguguugaaaucgagc

SEQ ID NO: 4196 - RNA, 20 nt, Artificial Sequence
  Synthetic
ugggguuugcagaaugaccu

SEQ ID NO: 4197 - RNA, 20 nt, Artificial Sequence
  Synthetic
ccuaaaucccuaccauccua

SEQ ID NO: 4198 - RNA, 20 nt, Artificial Sequence
  Synthetic
caaacccacggcagugucua

SEQ ID NO: 4199 - RNA, 20 nt, Artificial Sequence
  Synthetic
caguggaaguguuaaguggc

SEQ ID NO: 4200 - RNA, 20 nt, Artificial Sequence
  Synthetic
gugaugauaaaggcuuugug

SEQ ID NO: 4201 - RNA, 20 nt, Artificial Sequence
  Synthetic
uauggguuucuauaaucugu

SEQ ID NO: 4202 - RNA, 20 nt, Artificial Sequence
  Synthetic
acugcuguggagaaaacaca

SEQ ID NO: 4203 - RNA, 20 nt, Artificial Sequence
  Synthetic
ccccaucucagggcaugcaa

SEQ ID NO: 4204 - RNA, 20 nt, Artificial Sequence
  Synthetic
aaugugguaguaguaagaug

SEQ ID NO: 4205 - RNA, 20 nt, Artificial Sequence
  Synthetic
uauuauuucaaagauugaga

SEQ ID NO: 4206 - RNA, 20 nt, Artificial Sequence
  Synthetic
auauuauuucaaagauugag

SEQ ID NO: 4207 - RNA, 20 nt, Artificial Sequence
  Synthetic
aaacccacggcagugucuag

SEQ ID NO: 4208 - RNA, 20 nt, Artificial Sequence
  Synthetic
agggaugcuccaggggacag

SEQ ID NO: 4209 - RNA, 20 nt, Artificial Sequence
  Synthetic
cagaggugggacucagcccc

SEQ ID NO: 4210 - RNA, 20 nt, Artificial Sequence
  Synthetic
agcaacauaugacacaguuc

SEQ ID NO: 4211 - RNA, 20 nt, Artificial Sequence
  Synthetic
agugaggcuuccauuucaga

SEQ ID NO: 4212 - RNA, 20 nt, Artificial Sequence
  Synthetic
uucagggaagaagaggugaa

SEQ ID NO: 4213 - RNA, 20 nt, Artificial Sequence
  Synthetic
uuucaggagagaaaggguca

SEQ ID NO: 4214 - RNA, 20 nt, Artificial Sequence
  Synthetic
uccccaucucagggcaugca

SEQ ID NO: 4215 - RNA, 20 nt, Artificial Sequence
  Synthetic
agccccugguggccauagga

SEQ ID NO: 4216 - RNA, 20 nt, Artificial Sequence
  Synthetic
gaaucgucugauugcuggag

SEQ ID NO: 4217 - RNA, 20 nt, Artificial Sequence
  Synthetic
aagacauaggaagccaggug

SEQ ID NO: 4218 - RNA, 20 nt, Artificial Sequence
  Synthetic
gccucucuuccuuggacucu

SEQ ID NO: 4219 - RNA, 20 nt, Artificial Sequence
  Synthetic
ggagcgagggcuuaauguuu

SEQ ID NO: 4220 - RNA, 20 nt, Artificial Sequence
  Synthetic
acauugcauaaaucuaagau

SEQ ID NO: 4221 - RNA, 20 nt, Artificial Sequence
  Synthetic
gggagcccagacaggcugga

SEQ ID NO: 4222 - RNA, 20 nt, Artificial Sequence
  Synthetic
aaacauaaaucccgagaggu

SEQ ID NO: 4223 - RNA, 20 nt, Artificial Sequence
  Synthetic
ucuaccuccugcccaccucu

SEQ ID NO: 4224 - RNA, 20 nt, Artificial Sequence
  Synthetic
ggccaucaaccggcggaacg

SEQ ID NO: 4225 - RNA, 20 nt, Artificial Sequence
  Synthetic
aggcguugagaggagugcgc

SEQ ID NO: 4226 - RNA, 20 nt, Artificial Sequence
  Synthetic
uguccugcccuauacccgga

SEQ ID NO: 4227 - RNA, 20 nt, Artificial Sequence
  Synthetic
augcuuugguaaacauuucu

SEQ ID NO: 4228 - RNA, 20 nt, Artificial Sequence
  Synthetic
gugggccaugugaggcuuug

SEQ ID NO: 4229 - RNA, 20 nt, Artificial Sequence
  Synthetic
ggcgggauaaucacuugagc

SEQ ID NO: 4230 - RNA, 20 nt, Artificial Sequence
  Synthetic
cuggugacaauauaauucca

SEQ ID NO: 4231 - RNA, 20 nt, Artificial Sequence
  Synthetic
ggccagcuucaggagggagg

SEQ ID NO: 4232 - RNA, 20 nt, Artificial Sequence
  Synthetic
uaggacugggccuucugaaa

SEQ ID NO: 4233 - RNA, 20 nt, Artificial Sequence
  Synthetic
ucccuugcaugcccugagau

SEQ ID NO: 4234 - RNA, 20 nt, Artificial Sequence
  Synthetic
guccccuuguccccaucuca

SEQ ID NO: 4235 - RNA, 20 nt, Artificial Sequence
  Synthetic
ugugugauauuccuucccuc

SEQ ID NO: 4236 - RNA, 20 nt, Artificial Sequence
  Synthetic
cugcccuauacccggaggga

SEQ ID NO: 4237 - RNA, 20 nt, Artificial Sequence
  Synthetic
cuuaaaauccaacagaaaac

SEQ ID NO: 4238 - RNA, 20 nt, Artificial Sequence
  Synthetic
acauaggaagccaggugcgg

SEQ ID NO: 4239 - RNA, 20 nt, Artificial Sequence
  Synthetic
guggcaguggaaguguuaag

SEQ ID NO: 4240 - RNA, 20 nt, Artificial Sequence
  Synthetic
cccuugcaugcccugagaug

SEQ ID NO: 4241 - RNA, 20 nt, Artificial Sequence
  Synthetic
gguccccuuguccccaucuc

SEQ ID NO: 4242 - RNA, 20 nt, Artificial Sequence
  Synthetic
auaaaucccgagaggugggc

SEQ ID NO: 4243 - RNA, 20 nt, Artificial Sequence
  Synthetic
uaugagcauuuccaguuugg

SEQ ID NO: 4244 - RNA, 20 nt, Artificial Sequence
  Synthetic
uauuuguaauacccccaaac

SEQ ID NO: 4245 - RNA, 20 nt, Artificial Sequence
  Synthetic
gcccaggagagacagcagug

SEQ ID NO: 4246 - RNA, 20 nt, Artificial Sequence
  Synthetic
ucacuuuuuaaauagcaaag

SEQ ID NO: 4247 - RNA, 20 nt, Artificial Sequence
  Synthetic
ucugugcucugcaaaugacc

SEQ ID NO: 4248 - RNA, 20 nt, Artificial Sequence
  Synthetic
aggucauucugcaaacccca

SEQ ID NO: 4249 - RNA, 20 nt, Artificial Sequence
  Synthetic
uagguuugucuauaauguac

SEQ ID NO: 4250 - RNA, 20 nt, Artificial Sequence
  Synthetic
accuucucaaguagcaauga

SEQ ID NO: 4251 - RNA, 20 nt, Artificial Sequence
  Synthetic
guauggguuucuauaaucug

SEQ ID NO: 4252 - RNA, 20 nt, Artificial Sequence
  Synthetic
uaccaaucuuugugcauggc

SEQ ID NO: 4253 - RNA, 20 nt, Artificial Sequence
  Synthetic
gacgugcagaaggcguugag

SEQ ID NO: 4254 - RNA, 20 nt, Artificial Sequence
  Synthetic
cucacuuaucucaagguuca

SEQ ID NO: 4255 - RNA, 20 nt, Artificial Sequence
  Synthetic
uucaggagagaaagggucaa

SEQ ID NO: 4256 - RNA, 20 nt, Artificial Sequence
  Synthetic
uaggacuucuucgcaucgcg

SEQ ID NO: 4257 - RNA, 20 nt, Artificial Sequence
  Synthetic
cugcucuucguggacauuuc

SEQ ID NO: 4258 - RNA, 20 nt, Artificial Sequence
  Synthetic
agaaauagagaaaagaggcc

SEQ ID NO: 4259 - RNA, 20 nt, Artificial Sequence
  Synthetic
acugguuacucacccgcuau

SEQ ID NO: 4260 - RNA, 20 nt, Artificial Sequence
  Synthetic
aggacuucuucgcaucgcgg

SEQ ID NO: 4261 - RNA, 20 nt, Artificial Sequence
  Synthetic
caacacgaaucugaacaaac

SEQ ID NO: 4262 - RNA, 20 nt, Artificial Sequence
  Synthetic
agaagugauaugcuucaauu

SEQ ID NO: 4263 - RNA, 20 nt, Artificial Sequence
  Synthetic
gauaaucacuugagcugggg

SEQ ID NO: 4264 - RNA, 20 nt, Artificial Sequence
  Synthetic
auaugagcauuuccaguuug

SEQ ID NO: 4265 - RNA, 20 nt, Artificial Sequence
  Synthetic
cgggauaaucacuugagcug

SEQ ID NO: 4266 - RNA, 20 nt, Artificial Sequence
  Synthetic
cgggagaaucgucugauugc

SEQ ID NO: 4267 - RNA, 20 nt, Artificial Sequence
  Synthetic
ucaccaaaggagaagcaaca

SEQ ID NO: 4268 - RNA, 20 nt, Artificial Sequence
  Synthetic
ggggaggaggaugaucuguu

SEQ ID NO: 4269 - RNA, 20 nt, Artificial Sequence
  Synthetic
cguuggaugaagguucauuu

SEQ ID NO: 4270 - RNA, 20 nt, Artificial Sequence
  Synthetic
aggucaauucugcccauagc

SEQ ID NO: 4271 - RNA, 20 nt, Artificial Sequence
  Synthetic
auggccagcuucaggaggga

SEQ ID NO: 4272 - RNA, 20 nt, Artificial Sequence
  Synthetic
aaauuuauuucguacaauac

SEQ ID NO: 4273 - RNA, 20 nt, Artificial Sequence
  Synthetic
gaagagcgcacgauagacgc

SEQ ID NO: 4274 - RNA, 20 nt, Artificial Sequence
  Synthetic
ccacugcuucuguccuucag

SEQ ID NO: 4275 - RNA, 20 nt, Artificial Sequence
  Synthetic
caaagaaauucuauggacgg

SEQ ID NO: 4276 - RNA, 20 nt, Artificial Sequence
  Synthetic
aaggaugaggucgggugcag

SEQ ID NO: 4277 - RNA, 20 nt, Artificial Sequence
  Synthetic
gaucaaaggguaugaucuaa

SEQ ID NO: 4278 - RNA, 20 nt, Artificial Sequence
  Synthetic
uuuuguguccacuguaggcu

SEQ ID NO: 4279 - RNA, 20 nt, Artificial Sequence
  Synthetic
agggaaggaauaucacacag

SEQ ID NO: 4280 - RNA, 20 nt, Artificial Sequence
  Synthetic
cuaggacuucuucgcaucgc

SEQ ID NO: 4281 - RNA, 20 nt, Artificial Sequence
  Synthetic
accaaucuuugugcauggcu

SEQ ID NO: 4282 - RNA, 20 nt, Artificial Sequence
  Synthetic
uuggcgacaacauauuguaa

SEQ ID NO: 4283 - RNA, 20 nt, Artificial Sequence
  Synthetic
uggccagcuucaggagggag

SEQ ID NO: 4284 - RNA, 20 nt, Artificial Sequence
  Synthetic
gggaggaggaugaucuguuu

SEQ ID NO: 4285 - RNA, 20 nt, Artificial Sequence
  Synthetic
uagggaagcccucacugaga

SEQ ID NO: 4286 - RNA, 20 nt, Artificial Sequence
  Synthetic
aaggucaauucugcccauag

SEQ ID NO: 4287 - RNA, 20 nt, Artificial Sequence
  Synthetic
aucuaauuguggcacaguga

SEQ ID NO: 4288 - RNA, 20 nt, Artificial Sequence
  Synthetic
uacuggaggggggcagcgcg

SEQ ID NO: 4289 - RNA, 20 nt, Artificial Sequence
  Synthetic
caucuaauuguggcacagug

SEQ ID NO: 4290 - RNA, 20 nt, Artificial Sequence
  Synthetic
gcucugaagcacuugaaaug

SEQ ID NO: 4291 - RNA, 20 nt, Artificial Sequence
  Synthetic
cuaugucuuauaauugaguc

SEQ ID NO: 4292 - RNA, 20 nt, Artificial Sequence
  Synthetic
uuuauuucguacaauacugg

SEQ ID NO: 4293 - RNA, 20 nt, Artificial Sequence
  Synthetic
aaucccgagaggugggcagg

SEQ ID NO: 4294 - RNA, 20 nt, Artificial Sequence
  Synthetic
guauagcgccaagccuacag

SEQ ID NO: 4295 - RNA, 20 nt, Artificial Sequence
  Synthetic
aaccggaaugcuauugacgg

SEQ ID NO: 4296 - RNA, 20 nt, Artificial Sequence
  Synthetic
uuguuuuguucaaaaugucu

SEQ ID NO: 4297 - RNA, 20 nt, Artificial Sequence
  Synthetic
ucuaggacuucuucgcaucg

SEQ ID NO: 4298 - RNA, 20 nt, Artificial Sequence
  Synthetic
ccuaguuuagucucuuggau

SEQ ID NO: 4299 - RNA, 20 nt, Artificial Sequence
  Synthetic
uuuaaauuccaauaccacau

SEQ ID NO: 4300 - RNA, 20 nt, Artificial Sequence
  Synthetic
agcauccuuugaacuuuaga

SEQ ID NO: 4301 - RNA, 20 nt, Artificial Sequence
  Synthetic
gcgggauaaucacuugagcu

SEQ ID NO: 4302 - RNA, 20 nt, Artificial Sequence
  Synthetic
acucuguaacacacgccugc

SEQ ID NO: 4303 - RNA, 20 nt, Artificial Sequence
  Synthetic
aagcguuuugcgcaggagag

SEQ ID NO: 4304 - RNA, 20 nt, Artificial Sequence
  Synthetic
agagcuuuggccgaggacga

SEQ ID NO: 4305 - RNA, 20 nt, Artificial Sequence
  Synthetic
agagacagaaagucgauccg

SEQ ID NO: 4306 - RNA, 20 nt, Artificial Sequence
  Synthetic
cuauuaaaaaggaugagguc

SEQ ID NO: 4307 - RNA, 20 nt, Artificial Sequence
  Synthetic
ugaaggacagaagcagugga

SEQ ID NO: 4308 - RNA, 20 nt, Artificial Sequence
  Synthetic
cugaaggacagaagcagugg

SEQ ID NO: 4309 - RNA, 20 nt, Artificial Sequence
  Synthetic
uaccuuauuucacuguaaug

SEQ ID NO: 4310 - RNA, 20 nt, Artificial Sequence
  Synthetic
aauuagaccugcccaguuag

SEQ ID NO: 4311 - RNA, 20 nt, Artificial Sequence
  Synthetic
cugauauccacuaacugggc

SEQ ID NO: 4312 - RNA, 20 nt, Artificial Sequence
  Synthetic
auugcugauauccacuaacu

SEQ ID NO: 4313 - RNA, 20 nt, Artificial Sequence
  Synthetic
caggcugucaggaggcauga

SEQ ID NO: 4314 - RNA, 20 nt, Artificial Sequence
  Synthetic
aaauaucuuacuucauuacu

SEQ ID NO: 4315 - RNA, 20 nt, Artificial Sequence
  Synthetic
uuuucugguaugauacuauu

SEQ ID NO: 4316 - RNA, 20 nt, Artificial Sequence
  Synthetic
cugguaugauacuauuaggu

SEQ ID NO: 4317 - RNA, 20 nt, Artificial Sequence
  Synthetic
aucucuugaugaacagcuac

SEQ ID NO: 4318 - RNA, 20 nt, Artificial Sequence
  Synthetic
gaugaacagcuacaggccug

SEQ ID NO: 4319 - RNA, 20 nt, Artificial Sequence
  Synthetic
acagcuacaggccugagguu

SEQ ID NO: 4320 - RNA, 20 nt, Artificial Sequence
  Synthetic
cuacaugaacuccuaaccuc

SEQ ID NO: 4321 - RNA, 20 nt, Artificial Sequence
  Synthetic
guccuucagccucaacuuau

SEQ ID NO: 4322 - RNA, 20 nt, Artificial Sequence
  Synthetic
caccuauaaguugaggcuga

SEQ ID NO: 4323 - RNA, 20 nt, Artificial Sequence
  Synthetic
acacagucaccuauaaguug

SEQ ID NO: 4324 - RNA, 20 nt, Artificial Sequence
  Synthetic
ucguuaacuccgcagagcac

SEQ ID NO: 4325 - RNA, 20 nt, Artificial Sequence
  Synthetic
cguuaacuccgcagagcaca

SEQ ID NO: 4326 - RNA, 20 nt, Artificial Sequence
  Synthetic
ggauggugcccugugcucug

SEQ ID NO: 4327 - RNA, 20 nt, Artificial Sequence
  Synthetic
cuauccccagcaccuaaagc

SEQ ID NO: 4328 - RNA, 20 nt, Artificial Sequence
  Synthetic
uauccccagcaccuaaagcu

SEQ ID NO: 4329 - RNA, 20 nt, Artificial Sequence
  Synthetic
gguagggauuuaggaaaaag

SEQ ID NO: 4330 - RNA, 20 nt, Artificial Sequence
  Synthetic
agggauuuaggaaaaagagg

SEQ ID NO: 4331 - RNA, 20 nt, Artificial Sequence
  Synthetic
uuuaggaaaaagaggaggcu

SEQ ID NO: 4332 - RNA, 20 nt, Artificial Sequence
  Synthetic
aggaaaaagaggaggcuugg

SEQ ID NO: 4333 - RNA, 20 nt, Artificial Sequence
  Synthetic
gaucaucuagcacauguuuu

SEQ ID NO: 4334 - RNA, 20 nt, Artificial Sequence
  Synthetic
cuagcacauguuuuugguuu

SEQ ID NO: 4335 - RNA, 20 nt, Artificial Sequence
  Synthetic
uaucugguggguagcuacuu

SEQ ID NO: 4336 - RNA, 20 nt, Artificial Sequence
  Synthetic
gguggguagcuacuuaggag

SEQ ID NO: 4337 - RNA, 20 nt, Artificial Sequence
  Synthetic
ccugcuuccugcuucauccc

SEQ ID NO: 4338 - RNA, 20 nt, Artificial Sequence
  Synthetic
gaaggugccagggaugaagc

SEQ ID NO: 4339 - RNA, 20 nt, Artificial Sequence
  Synthetic
uugccccuuccgccauggga

SEQ ID NO: 4340 - RNA, 20 nt, Artificial Sequence
  Synthetic
cuugccccuuccgccauggg

SEQ ID NO: 4341 - RNA, 20 nt, Artificial Sequence
  Synthetic
uagcuugccccuuccgccau

SEQ ID NO: 4342 - RNA, 20 nt, Artificial Sequence
  Synthetic
cuagcuugccccuuccgcca

SEQ ID NO: 4343 - RNA, 20 nt, Artificial Sequence
  Synthetic
acuaacauucacaucauagc

SEQ ID NO: 4344 - RNA, 20 nt, Artificial Sequence
  Synthetic
cuaacauucacaucauagca

SEQ ID NO: 4345 - RNA, 20 nt, Artificial Sequence
  Synthetic
ucacaucauagcagggacuc

SEQ ID NO: 4346 - RNA, 20 nt, Artificial Sequence
  Synthetic
caucauagcagggacucugg

SEQ ID NO: 4347 - RNA, 20 nt, Artificial Sequence
  Synthetic
gggagcgccaucuuuguagc

SEQ ID NO: 4348 - RNA, 20 nt, Artificial Sequence
  Synthetic
ucaaguagcaaugaagguua

SEQ ID NO: 4349 - RNA, 20 nt, Artificial Sequence
  Synthetic
cucaaguagcaaugaagguu

SEQ ID NO: 4350 - RNA, 20 nt, Artificial Sequence
  Synthetic
ggaagaccugugcauuuuug

SEQ ID NO: 4351 - RNA, 20 nt, Artificial Sequence
  Synthetic
aacuguccacaaaaaugcac

SEQ ID NO: 4352 - RNA, 20 nt, Artificial Sequence
  Synthetic
auuuauuuuuagcagagaca

SEQ ID NO: 4353 - RNA, 20 nt, Artificial Sequence
  Synthetic
gguuggugcaagaguaacug

SEQ ID NO: 4354 - RNA, 20 nt, Artificial Sequence
  Synthetic
auaucggcucacugcaaccc

SEQ ID NO: 4355 - RNA, 20 nt, Artificial Sequence
  Synthetic
agccagcaucuucucucccu

SEQ ID NO: 4356 - RNA, 20 nt, Artificial Sequence
  Synthetic
caccugugauccgagcuacu

SEQ ID NO: 4357 - RNA, 20 nt, Artificial Sequence
  Synthetic
uacucgggggaggcugaagc

SEQ ID NO: 4358 - RNA, 20 nt, Artificial Sequence
  Synthetic
gaacgagguggaguuuggcc

SEQ ID NO: 4359 - RNA, 20 nt, Artificial Sequence
  Synthetic
gcaucacugcaccucagucu

SEQ ID NO: 4360 - RNA, 20 nt, Artificial Sequence
  Synthetic
uggguuuugccauauugcuc

SEQ ID NO: 4361 - RNA, 20 nt, Artificial Sequence
  Synthetic
cuacuuaggaguggaauugc

SEQ ID NO: 4362 - RNA, 20 nt, Artificial Sequence
  Synthetic
uucagccucccccgaguagc

SEQ ID NO: 4363 - RNA, 20 nt, Artificial Sequence
  Synthetic
cacuuccacugccaccaccc

SEQ ID NO: 4364 - RNA, 20 nt, Artificial Sequence
  Synthetic
ugcaucacugcaccucaguc

SEQ ID NO: 4365 - RNA, 20 nt, Artificial Sequence
  Synthetic
uccacagccuugucaacacu

SEQ ID NO: 4366 - RNA, 20 nt, Artificial Sequence
  Synthetic
cucugggggagcauacagac

SEQ ID NO: 4367 - RNA, 20 nt, Artificial Sequence
  Synthetic
ucccccagagguuugagcag

SEQ ID NO: 4368 - RNA, 20 nt, Artificial Sequence
  Synthetic
agggagagaagaugcuggcu

SEQ ID NO: 4369 - RNA, 20 nt, Artificial Sequence
  Synthetic
ucuuagccuaggaagauuca

SEQ ID NO: 4370 - RNA, 20 nt, Artificial Sequence
  Synthetic
guaucucaggguucuugccu

SEQ ID NO: 4371 - RNA, 20 nt, Artificial Sequence
  Synthetic
cucaagugguuugcccgccu

SEQ ID NO: 4372 - RNA, 20 nt, Artificial Sequence
  Synthetic
caaaaccagccugagcaaua

SEQ ID NO: 4373 - RNA, 20 nt, Artificial Sequence
  Synthetic
ugaggcgggucuaucaccug

SEQ ID NO: 4374 - RNA, 20 nt, Artificial Sequence
  Synthetic
ugcccaggggcugggggagg

SEQ ID NO: 4375 - RNA, 20 nt, Artificial Sequence
  Synthetic
cagccaugagccacugcguc

SEQ ID NO: 4376 - RNA, 20 nt, Artificial Sequence
  Synthetic
uaagauguggggccuuuggg

SEQ ID NO: 4377 - RNA, 20 nt, Artificial Sequence
  Synthetic
caaaaaguaucugggcauga

SEQ ID NO: 4378 - RNA, 20 nt, Artificial Sequence
  Synthetic
uuaaauuaauuaaaauuggc

SEQ ID NO: 4379 - RNA, 20 nt, Artificial Sequence
  Synthetic
uggaagugagcagagagaga

SEQ ID NO: 4380 - RNA, 20 nt, Artificial Sequence
  Synthetic
ccgucuguaugcucccccag

SEQ ID NO: 4381 - RNA, 20 nt, Artificial Sequence
  Synthetic
cagcauuugggcacgaaggc

SEQ ID NO: 4382 - RNA, 20 nt, Artificial Sequence
  Synthetic
caugcccugagauggggaca

SEQ ID NO: 4383 - RNA, 20 nt, Artificial Sequence
  Synthetic
acuuccacugccaccacccu

SEQ ID NO: 4384 - RNA, 20 nt, Artificial Sequence
  Synthetic
uuuacagcugaggccccagc

SEQ ID NO: 4385 - RNA, 20 nt, Artificial Sequence
  Synthetic
augcccugagauggggacaa

SEQ ID NO: 4386 - RNA, 20 nt, Artificial Sequence
  Synthetic
uugaaugaaugaaugcuuug

SEQ ID NO: 4387 - RNA, 20 nt, Artificial Sequence
  Synthetic
aaugcagcauuugggcacga

SEQ ID NO: 4388 - RNA, 20 nt, Artificial Sequence
  Synthetic
uaaaauuacaaaaaugaucc

SEQ ID NO: 4389 - RNA, 20 nt, Artificial Sequence
  Synthetic
ggaaggagcucucagcagau

SEQ ID NO: 4390 - RNA, 20 nt, Artificial Sequence
  Synthetic
aaguaucugggcaugauggc

SEQ ID NO: 4391 - RNA, 20 nt, Artificial Sequence
  Synthetic
ugccccgcugcucaaaccuc

SEQ ID NO: 4392 - RNA, 20 nt, Artificial Sequence
  Synthetic
ugcagcuauuaaaaaggaug

SEQ ID NO: 4393 - RNA, 20 nt, Artificial Sequence
  Synthetic
acgccacuguacucccagcc

SEQ ID NO: 4394 - RNA, 20 nt, Artificial Sequence
  Synthetic
uauuguauuucuuguagaga

SEQ ID NO: 4395 - RNA, 20 nt, Artificial Sequence
  Synthetic
ugagucucgcucagucaccc

SEQ ID NO: 4396 - RNA, 20 nt, Artificial Sequence
  Synthetic
uuggcggaagaagacacaag

SEQ ID NO: 4397 - RNA, 20 nt, Artificial Sequence
  Synthetic
ccgagcuacuuggaagacug

SEQ ID NO: 4398 - RNA, 20 nt, Artificial Sequence
  Synthetic
aaggagcucucagcagauag

SEQ ID NO: 4399 - RNA, 20 nt, Artificial Sequence
  Synthetic
ugaagcacuugaaauguggc

SEQ ID NO: 4400 - RNA, 20 nt, Artificial Sequence
  Synthetic
gaaggagcucucagcagaua

SEQ ID NO: 4401 - RNA, 20 nt, Artificial Sequence
  Synthetic
ggagggaaggaauaucacac

SEQ ID NO: 4402 - RNA, 20 nt, Artificial Sequence
  Synthetic
gagggaaggaauaucacaca

SEQ ID NO: 4403 - RNA, 20 nt, Artificial Sequence
  Synthetic
uggccggacgcaguggcuca

SEQ ID NO: 4404 - RNA, 20 nt, Artificial Sequence
  Synthetic
cgggucuaucaccugagguc

SEQ ID NO: 4405 - RNA, 20 nt, Artificial Sequence
  Synthetic
uggcuguaauucuaacacuu

SEQ ID NO: 4406 - RNA, 20 nt, Artificial Sequence
  Synthetic
ggcuguaauucuaacacuuu

SEQ ID NO: 4407 - RNA, 20 nt, Artificial Sequence
  Synthetic
ggcuugagcccuggaguuca

SEQ ID NO: 4408 - RNA, 20 nt, Artificial Sequence
  Synthetic
ccucugggggagcauacaga

SEQ ID NO: 4409 - RNA, 20 nt, Artificial Sequence
  Synthetic
gggggagcauacagacgggc

SEQ ID NO: 4410 - RNA, 20 nt, Artificial Sequence
  Synthetic
agggucucgccaugcugccc

SEQ ID NO: 4411 - RNA, 20 nt, Artificial Sequence
  Synthetic
augagccacugcguccggcc

SEQ ID NO: 4412 - RNA, 20 nt, Artificial Sequence
  Synthetic
gaggagaaucgauugaaccc

SEQ ID NO: 4413 - RNA, 20 nt, Artificial Sequence
  Synthetic
caaggcaggaguaucaccug

SEQ ID NO: 4414 - RNA, 20 nt, Artificial Sequence
  Synthetic
acaaaaggggccgggcgcgg

SEQ ID NO: 4415 - RNA, 20 nt, Artificial Sequence
  Synthetic
aaaaaggaugaguucaugua

SEQ ID NO: 4416 - RNA, 20 nt, Artificial Sequence
  Synthetic
cugucguggggugggggagc

SEQ ID NO: 4417 - RNA, 20 nt, Artificial Sequence
  Synthetic
cgccacuguacucccagccu

SEQ ID NO: 4418 - RNA, 20 nt, Artificial Sequence
  Synthetic
ugcccaggcugggaguacag

SEQ ID NO: 4419 - RNA, 20 nt, Artificial Sequence
  Synthetic
caaaaauacaaaaaguaucu

SEQ ID NO: 4420 - RNA, 20 nt, Artificial Sequence
  Synthetic
acaaaaauacaaaaaguauc

SEQ ID NO: 4421 - RNA, 20 nt, Artificial Sequence
  Synthetic
cgggcaaaccacuugagguc

SEQ ID NO: 4422 - RNA, 20 nt, Artificial Sequence
  Synthetic
uuguaucuuuaguagagcca

SEQ ID NO: 4423 - RNA, 20 nt, Artificial Sequence
  Synthetic
aauaaauuagccggaugugg

SEQ ID NO: 4424 - RNA, 20 nt, Artificial Sequence
  Synthetic
gagacaggguuucagcaugc

SEQ ID NO: 4425 - RNA, 20 nt, Artificial Sequence
  Synthetic
cccccagagguuugagcagc

SEQ ID NO: 4426 - RNA, 20 nt, Artificial Sequence
  Synthetic
aaaaaaggaugaguucaugu

SEQ ID NO: 4427 - RNA, 20 nt, Artificial Sequence
  Synthetic
agcaccacugcacuccagug

SEQ ID NO: 4428 - RNA, 20 nt, Artificial Sequence
  Synthetic
cagguguccugcccuauacc

SEQ ID NO: 4429 - RNA, 20 nt, Artificial Sequence
  Synthetic
gcuuguagucccagcuacca

SEQ ID NO: 4430 - RNA, 20 nt, Artificial Sequence
  Synthetic
gaugaguucauguagggaca

SEQ ID NO: 4431 - RNA, 20 nt, Artificial Sequence
  Synthetic
ccaugggaggcugaggugag

SEQ ID NO: 4432 - RNA, 20 nt, Artificial Sequence
  Synthetic
uauuuauuuuuagcagagac

SEQ ID NO: 4433 - RNA, 20 nt, Artificial Sequence
  Synthetic
uuuguaucuuuaguagagcc

SEQ ID NO: 4434 - RNA, 20 nt, Artificial Sequence
  Synthetic
agacgggguuucaccagguu

SEQ ID NO: 4435 - RNA, 20 nt, Artificial Sequence
  Synthetic
gggcuugcagaaugagugca

SEQ ID NO: 4436 - RNA, 20 nt, Artificial Sequence
  Synthetic
ggccugcuucagggaagaag

SEQ ID NO: 4437 - RNA, 20 nt, Artificial Sequence
  Synthetic
aggguuucagcaugcuggcc

SEQ ID NO: 4438 - RNA, 20 nt, Artificial Sequence
  Synthetic
ugagaccagccugcccaacc

SEQ ID NO: 4439 - RNA, 20 nt, Artificial Sequence
  Synthetic
caggcaugagcuaccccgcc

SEQ ID NO: 4440 - RNA, 20 nt, Artificial Sequence
  Synthetic
aaaaaaaaaaaaacaagucu

SEQ ID NO: 4441 - RNA, 20 nt, Artificial Sequence
  Synthetic
auaaaauaccauaaacuagg

SEQ ID NO: 4442 - RNA, 20 nt, Artificial Sequence
  Synthetic
gccgguaaucccaguuacuc

SEQ ID NO: 4443 - RNA, 20 nt, Artificial Sequence
  Synthetic
uguuaauuuuuuuguagaga

SEQ ID NO: 4444 - RNA, 20 nt, Artificial Sequence
  Synthetic
cucaaacuucugagcucaag

SEQ ID NO: 4445 - RNA, 20 nt, Artificial Sequence
  Synthetic
auacuaugcagcuauuaaaa

SEQ ID NO: 4446 - RNA, 20 nt, Artificial Sequence
  Synthetic
agaaaagaggccaggugcag

SEQ ID NO: 4447 - RNA, 20 nt, Artificial Sequence
  Synthetic
guuaauuuuuuuguagagac

SEQ ID NO: 4448 - RNA, 20 nt, Artificial Sequence
  Synthetic
cuucaggaggccaaggccag

SEQ ID NO: 4449 - RNA, 20 nt, Artificial Sequence
  Synthetic
caaaaaugauccgggcgugg

SEQ ID NO: 4450 - RNA, 20 nt, Artificial Sequence
  Synthetic
gcacaggaugggggcguggu

SEQ ID NO: 4451 - RNA, 20 nt, Artificial Sequence
  Synthetic
ggucuggaacucucgaccuc

SEQ ID NO: 4452 - RNA, 20 nt, Artificial Sequence
  Synthetic
ugccaaauaguuuuccaaag

SEQ ID NO: 4453 - RNA, 20 nt, Artificial Sequence
  Synthetic
ccugucacaugagggucuuc

SEQ ID NO: 4454 - RNA, 20 nt, Artificial Sequence
  Synthetic
ccucuaaucccagcuacucg

SEQ ID NO: 4455 - RNA, 20 nt, Artificial Sequence
  Synthetic
ggcugggaaguccacgauca

SEQ ID NO: 4456 - RNA, 20 nt, Artificial Sequence
  Synthetic
ccugaagacccucaugugac

SEQ ID NO: 4457 - RNA, 20 nt, Artificial Sequence
  Synthetic
cggaagaagacacaaguggc

SEQ ID NO: 4458 - RNA, 20 nt, Artificial Sequence
  Synthetic
gcaggacaccugucacauga

SEQ ID NO: 4459 - RNA, 20 nt, Artificial Sequence
  Synthetic
ugucacaugagggucuucag

SEQ ID NO: 4460 - RNA, 20 nt, Artificial Sequence
  Synthetic
cagcagauaggggagccaga

SEQ ID NO: 4461 - RNA, 20 nt, Artificial Sequence
  Synthetic
ggguuuucaccauguuuccc

SEQ ID NO: 4462 - RNA, 20 nt, Artificial Sequence
  Synthetic
ccccgaguagcugggauuag

SEQ ID NO: 4463 - RNA, 20 nt, Artificial Sequence
  Synthetic
cacuugagcuggggaggcgg

SEQ ID NO: 4464 - RNA, 20 nt, Artificial Sequence
  Synthetic
aucaaggugccagcagauuu

SEQ ID NO: 4465 - RNA, 20 nt, Artificial Sequence
  Synthetic
cugucacaugagggucuuca

SEQ ID NO: 4466 - RNA, 20 nt, Artificial Sequence
  Synthetic
guccgugggcacaggccugg

SEQ ID NO: 4467 - RNA, 20 nt, Artificial Sequence
  Synthetic
ggcaggacaccugucacaug

SEQ ID NO: 4468 - RNA, 20 nt, Artificial Sequence
  Synthetic
agcagauaggggagccagaa

SEQ ID NO: 4469 - RNA, 20 nt, Artificial Sequence
  Synthetic
cgcuugugugucugccugcu

SEQ ID NO: 4470 - RNA, 20 nt, Artificial Sequence
  Synthetic
ccggcaugcgccaccaugcc

SEQ ID NO: 4471 - RNA, 20 nt, Artificial Sequence
  Synthetic
ccagaccagccuggccaagg

SEQ ID NO: 4472 - RNA, 20 nt, Artificial Sequence
  Synthetic
cgugggcacaggccuggggg

SEQ ID NO: 4473 - RNA, 20 nt, Artificial Sequence
  Synthetic
agaaaacugcagaagcagga

SEQ ID NO: 4474 - RNA, 20 nt, Artificial Sequence
  Synthetic
cucuaaucccagcuacucgg

SEQ ID NO: 4475 - RNA, 20 nt, Artificial Sequence
  Synthetic
ggaugggggcguggugggcc

SEQ ID NO: 4476 - RNA, 20 nt, Artificial Sequence
  Synthetic
cucaggugauacuccugccu

SEQ ID NO: 4477 - RNA, 20 nt, Artificial Sequence
  Synthetic
ccaccuuggccaggcugguc

SEQ ID NO: 4478 - RNA, 20 nt, Artificial Sequence
  Synthetic
gucuugggaaaugcagcauu

SEQ ID NO: 4479 - RNA, 20 nt, Artificial Sequence
  Synthetic
ccaggcaugguggcgcaugc

SEQ ID NO: 4480 - RNA, 20 nt, Artificial Sequence
  Synthetic
cggaagaaucagaucacacg

SEQ ID NO: 4481 - RNA, 20 nt, Artificial Sequence
  Synthetic
gggguuucaccagguugggc

SEQ ID NO: 4482 - RNA, 20 nt, Artificial Sequence
  Synthetic
ucacugauggacguuugggu

SEQ ID NO: 4483 - RNA, 20 nt, Artificial Sequence
  Synthetic
aacguccaucagugauagac

SEQ ID NO: 4484 - RNA, 20 nt, Artificial Sequence
  Synthetic
ucuaucacugauggacguuu

SEQ ID NO: 4485 - RNA, 20 nt, Artificial Sequence
  Synthetic
gaugggggcguggugggcca

SEQ ID NO: 4486 - RNA, 20 nt, Artificial Sequence
  Synthetic
gcgaggaacaucacacacug

SEQ ID NO: 4487 - RNA, 20 nt, Artificial Sequence
  Synthetic
aaucacuugagcuggggagg

SEQ ID NO: 4488 - RNA, 20 nt, Artificial Sequence
  Synthetic
caggaguaucaccugagguc

SEQ ID NO: 4489 - RNA, 20 nt, Artificial Sequence
  Synthetic
guggggugggggagcgggga

SEQ ID NO: 4490 - RNA, 20 nt, Artificial Sequence
  Synthetic
uuucaccagguugggcaggc

SEQ ID NO: 4491 - RNA, 20 nt, Artificial Sequence
  Synthetic
ucuugggaaaugcagcauuu

SEQ ID NO: 4492 - RNA, 20 nt, Artificial Sequence
  Synthetic
guuccagaccagccuggcca

SEQ ID NO: 4493 - RNA, 20 nt, Artificial Sequence
  Synthetic
ucucgccaugcugcccaggc

SEQ ID NO: 4494 - RNA, 20 nt, Artificial Sequence
  Synthetic
uuucagcaugcuggccaggc

SEQ ID NO: 4495 - RNA, 20 nt, Artificial Sequence
  Synthetic
gggggcguggugggccaggg

SEQ ID NO: 4496 - RNA, 20 nt, Artificial Sequence
  Synthetic
gucuaucacugauggacguu

SEQ ID NO: 4497 - RNA, 20 nt, Artificial Sequence
  Synthetic
uaacacaagccgccuacaga

SEQ ID NO: 4498 - RNA, 20 nt, Artificial Sequence
  Synthetic
aauagcugcauaguauucca

SEQ ID NO: 4499 - RNA, 20 nt, Artificial Sequence
  Synthetic
uccugccucaggcucccgag

SEQ ID NO: 4500 - RNA, 20 nt, Artificial Sequence
  Synthetic
cuagcaggcagacacacaag

SEQ ID NO: 4501 - RNA, 20 nt, Artificial Sequence
  Synthetic
gccacucgggagccugaggc

SEQ ID NO: 4502 - RNA, 20 nt, Artificial Sequence
  Synthetic
agguccgugggcacaggccu

SEQ ID NO: 4503 - RNA, 20 nt, Artificial Sequence
  Synthetic
gccucaggcucccgaguggc

SEQ ID NO: 4504 - RNA, 20 nt, Artificial Sequence
  Synthetic
cccagccacucgggagccug

SEQ ID NO: 4505 - RNA, 20 nt, Artificial Sequence
  Synthetic
uguagagacgggguuucacc

SEQ ID NO: 4506 - RNA, 20 nt, Artificial Sequence
  Synthetic
acugccacuguacuccagcc

SEQ ID NO: 4507 - RNA, 20 nt, Artificial Sequence
  Synthetic
ucucaaacuucugagcucaa

SEQ ID NO: 4508 - RNA, 20 nt, Artificial Sequence
  Synthetic
gucucaaacuucugagcuca

SEQ ID NO: 4509 - RNA, 20 nt, Artificial Sequence
  Synthetic
ccucaggcucccgaguggcu

SEQ ID NO: 4510 - RNA, 20 nt, Artificial Sequence
  Synthetic
aggccugugcccacggaccu

SEQ ID NO: 4511 - RNA, 20 nt, Artificial Sequence
  Synthetic
accuguaaucccagccaccu

SEQ ID NO: 4512 - RNA, 20 nt, Artificial Sequence
  Synthetic
agagucucgcuguguugcuc

SEQ ID NO: 4513 - RNA, 20 nt, Artificial Sequence
  Synthetic
uagguccgugggcacaggcc

SEQ ID NO: 4514 - RNA, 20 nt, Artificial Sequence
  Synthetic
cacccccaggccugugccca

SEQ ID NO: 4515 - RNA, 20 nt, Artificial Sequence
  Synthetic
ucagccucccccgaguagcu

SEQ ID NO: 4516 - RNA, 20 nt, Artificial Sequence
  Synthetic
ggcacaggaugggggcgugg

SEQ ID NO: 4517 - RNA, 20 nt, Artificial Sequence
  Synthetic
gcuugugugucugccugcua

SEQ ID NO: 4518 - RNA, 20 nt, Artificial Sequence
  Synthetic
ccucucaccucagccuccca

SEQ ID NO: 4519 - RNA, 20 nt, Artificial Sequence
  Synthetic
auaauaaaauaccauaaacu

SEQ ID NO: 4520 - RNA, 20 nt, Artificial Sequence
  Synthetic
caccuguaaucccagccacc

SEQ ID NO: 4521 - RNA, 20 nt, Artificial Sequence
  Synthetic
cgucuguaaucccagccacu

SEQ ID NO: 4522 - RNA, 20 nt, Artificial Sequence
  Synthetic
aggagaaucacuugaaaccc

SEQ ID NO: 4523 - RNA, 20 nt, Artificial Sequence
  Synthetic
uaaucccagcuacucggggg

SEQ ID NO: 4524 - RNA, 20 nt, Artificial Sequence
  Synthetic
gggauuacagccaccaugcc

SEQ ID NO: 4525 - RNA, 20 nt, Artificial Sequence
  Synthetic
cuggaacuccugaccucaag

SEQ ID NO: 4526 - RNA, 20 nt, Artificial Sequence
  Synthetic
uacuuaggaguggaauugcu

SEQ ID NO: 4527 - RNA, 20 nt, Artificial Sequence
  Synthetic
gguccgugggcacaggccug

SEQ ID NO: 4528 - RNA, 20 nt, Artificial Sequence
  Synthetic
gagccaccaugcccggccca

SEQ ID NO: 4529 - RNA, 20 nt, Artificial Sequence
  Synthetic
cuuacucuugucgcccaggc

SEQ ID NO: 4530 - RNA, 20 nt, Artificial Sequence
  Synthetic
ccugucguggggugggggag

SEQ ID NO: 4531 - RNA, 20 nt, Artificial Sequence
  Synthetic
aggaggucgaggcugcagug

SEQ ID NO: 4532 - RNA, 20 nt, Artificial Sequence
  Synthetic
ggaagaaucagaucacacgu

SEQ ID NO: 4533 - RNA, 20 nt, Artificial Sequence
  Synthetic
auacagacgggcaggcugug

SEQ ID NO: 4534 - RNA, 20 nt, Artificial Sequence
  Synthetic
gaguggaauugcugggucau

SEQ ID NO: 4535 - RNA, 20 nt, Artificial Sequence
  Synthetic
gccugucaucccagcuacua

SEQ ID NO: 4536 - RNA, 20 nt, Artificial Sequence
  Synthetic
uuuauaagccaccuaguuua

SEQ ID NO: 4537 - RNA, 20 nt, Artificial Sequence
  Synthetic
gcauacagacgggcaggcug

SEQ ID NO: 4538 - RNA, 20 nt, Artificial Sequence
  Synthetic
uggugggccaggguggucuu

SEQ ID NO: 4539 - RNA, 20 nt, Artificial Sequence
  Synthetic
ucacucugucacccagacug

SEQ ID NO: 4540 - RNA, 20 nt, Artificial Sequence
  Synthetic
cauacagacgggcaggcugu

SEQ ID NO: 4541 - RNA, 20 nt, Artificial Sequence
  Synthetic
aacugaacaaugaaaacacu

SEQ ID NO: 4542 - RNA, 20 nt, Artificial Sequence
  Synthetic
cuuacucuguugcccaggcu

SEQ ID NO: 4543 - RNA, 20 nt, Artificial Sequence
  Synthetic
gguuuugaacuccugaccuu

SEQ ID NO: 4544 - RNA, 20 nt, Artificial Sequence
  Synthetic
guggugggccaggguggucu

SEQ ID NO: 4545 - RNA, 20 nt, Artificial Sequence
  Synthetic
caggugugcaccaccauggc

SEQ ID NO: 4546 - RNA, 20 nt, Artificial Sequence
  Synthetic
ucccuaguagcugggaugac

SEQ ID NO: 4547 - RNA, 20 nt, Artificial Sequence
  Synthetic
uuuugccauauugcucaggc

SEQ ID NO: 4548 - RNA, 20 nt, Artificial Sequence
  Synthetic
acuuggaagacugagguggg

SEQ ID NO: 4549 - RNA, 20 nt, Artificial Sequence
  Synthetic
cucagcacuuugggagggcg

SEQ ID NO: 4550 - RNA, 20 nt, Artificial Sequence
  Synthetic
gugucugccugcuagggucu

SEQ ID NO: 4551 - RNA, 20 nt, Artificial Sequence
  Synthetic
ugucaucccagcuacuaggg

SEQ ID NO: 4552 - RNA, 20 nt, Artificial Sequence
  Synthetic
ugugcccacggaccuaggug

SEQ ID NO: 4553 - RNA, 20 nt, Artificial Sequence
  Synthetic
gcuacuuggaagacugaggu

SEQ ID NO: 4554 - RNA, 20 nt, Artificial Sequence
  Synthetic
gccccgcugcucaaaccucu

SEQ ID NO: 4555 - RNA, 20 nt, Artificial Sequence
  Synthetic
ucuaacacuuugggaggcug

SEQ ID NO: 4556 - RNA, 20 nt, Artificial Sequence
  Synthetic
ucaccuagguccgugggcac

SEQ ID NO: 4557 - RNA, 20 nt, Artificial Sequence
  Synthetic
ucccagguggcugggauuac

SEQ ID NO: 4558 - RNA, 20 nt, Artificial Sequence
  Synthetic
agcuacuuggaagacugagg

SEQ ID NO: 4559 - RNA, 20 nt, Artificial Sequence
  Synthetic
caggccgaucacuugagguc

SEQ ID NO: 4560 - RNA, 20 nt, Artificial Sequence
  Synthetic
cagacgugugccaccacgcc

SEQ ID NO: 4561 - RNA, 20 nt, Artificial Sequence
  Synthetic
gucucaaauuccugggcuca

SEQ ID NO: 4562 - RNA, 20 nt, Artificial Sequence
  Synthetic
acuacaggugugcaccacca

SEQ ID NO: 4563 - RNA, 20 nt, Artificial Sequence
  Synthetic
gagacaggguuucaccaccu

SEQ ID NO: 4564 - RNA, 20 nt, Artificial Sequence
  Synthetic
uguaaucccagccaccuggg

SEQ ID NO: 4565 - RNA, 20 nt, Artificial Sequence
  Synthetic
gacuguaaucccagcacuuc

SEQ ID NO: 4566 - RNA, 20 nt, Artificial Sequence
  Synthetic
cucaagcaauccucuggccu

SEQ ID NO: 4567 - RNA, 20 nt, Artificial Sequence
  Synthetic
ucucaaauuccugggcucaa

SEQ ID NO: 4568 - RNA, 20 nt, Artificial Sequence
  Synthetic
aggguuucaccaccuuggcc

SEQ ID NO: 4569 - RNA, 20 nt, Artificial Sequence
  Synthetic
caggcgugagccccugcacc

SEQ ID NO: 4570 - RNA, 20 nt, Artificial Sequence
  Synthetic
uugcucaggguggagugcag

SEQ ID NO: 4571 - RNA, 20 nt, Artificial Sequence
  Synthetic
auaggcacaggaugggggcg

SEQ ID NO: 4572 - RNA, 20 nt, Artificial Sequence
  Synthetic
cacugcagccuugaacucca

SEQ ID NO: 4573 - RNA, 20 nt, Artificial Sequence
  Synthetic
gcuacuagggaggcugaggg

SEQ ID NO: 4574 - RNA, 20 nt, Artificial Sequence
  Synthetic
caggcacgcaccaccacauc

SEQ ID NO: 4575 - RNA, 20 nt, Artificial Sequence
  Synthetic
gccaccugggaggcugaggc

SEQ ID NO: 4576 - RNA, 20 nt, Artificial Sequence
  Synthetic
gaagacugcuugagcccagg

SEQ ID NO: 4577 - RNA, 20 nt, Artificial Sequence
  Synthetic
uccugccucagccucccagg

SEQ ID NO: 4578 - RNA, 20 nt, Artificial Sequence
  Synthetic
uaaauaaauaaaaauuagcc

SEQ ID NO: 4579 - RNA, 20 nt, Artificial Sequence
  Synthetic
uuaauuuuuuuguagagacg

SEQ ID NO: 4580 - RNA, 20 nt, Artificial Sequence
  Synthetic
gccucagccucccagguggc

SEQ ID NO: 4581 - RNA, 20 nt, Artificial Sequence
  Synthetic
cccucagccucccuaguagc

SEQ ID NO: 4582 - RNA, 20 nt, Artificial Sequence
  Synthetic
aaaaaaaaaaaaaaagacau

SEQ ID NO: 4583 - RNA, 20 nt, Artificial Sequence
  Synthetic
aaaaaaaaagccaggcacag

SEQ ID NO: 4584 - RNA, 20 nt, Artificial Sequence
  Synthetic
ccuguccucaccuagguccg

SEQ ID NO: 4585 - RNA, 20 nt, Artificial Sequence
  Synthetic
aacccgggagauggagguug

SEQ ID NO: 4586 - RNA, 20 nt, Artificial Sequence
  Synthetic
gucuguaaucccagccacuc

SEQ ID NO: 4587 - RNA, 20 nt, Artificial Sequence
  Synthetic
ggguuucaacauaugaauuu

SEQ ID NO: 4588 - RNA, 20 nt, Artificial Sequence
  Synthetic
cuguccucaccuagguccgu

SEQ ID NO: 4589 - RNA, 20 nt, Artificial Sequence
  Synthetic
ccacggaccuaggugaggac

SEQ ID NO: 4590 - RNA, 20 nt, Artificial Sequence
  Synthetic
ucuugcucugucacccacac

SEQ ID NO: 4591 - RNA, 20 nt, Artificial Sequence
  Synthetic
ucuuaaguagcugggacuac

SEQ ID NO: 4592 - RNA, 20 nt, Artificial Sequence
  Synthetic
ucaccacaaccuccaucucc

SEQ ID NO: 4593 - RNA, 20 nt, Artificial Sequence
  Synthetic
ccagcuacuagggaggcuga

SEQ ID NO: 4594 - RNA, 20 nt, Artificial Sequence
  Synthetic
aggagugccuguccucaccu

SEQ ID NO: 4595 - RNA, 20 nt, Artificial Sequence
  Synthetic
caccacaaccuccaucuccc

SEQ ID NO: 4596 - RNA, 20 nt, Artificial Sequence
  Synthetic
guuacucaggaagcugaggc

SEQ ID NO: 4597 - RNA, 20 nt, Artificial Sequence
  Synthetic
uguagucccagcuacuuaag

SEQ ID NO: 4598 - RNA, 20 nt, Artificial Sequence
  Synthetic
ccagaggauugcuugagccc

SEQ ID NO: 4599 - RNA, 20 nt, Artificial Sequence
  Synthetic
ggcuugagccugggagguug

SEQ ID NO: 4600 - RNA, 20 nt, Artificial Sequence
  Synthetic
gaucaaggugccagcagauu

SEQ ID NO: 4601 - RNA, 20 nt, Artificial Sequence
  Synthetic
ccucagccucccagguggcu

SEQ ID NO: 4602 - RNA, 20 nt, Artificial Sequence
  Synthetic
gggaggcugaggugagagga

SEQ ID NO: 4603 - RNA, 20 nt, Artificial Sequence
  Synthetic
cccagccaccugggaggcug

SEQ ID NO: 4604 - RNA, 20 nt, Artificial Sequence
  Synthetic
acaggugcagcacaccaaca

SEQ ID NO: 4605 - RNA, 20 nt, Artificial Sequence
  Synthetic
gcaccacugcacuccagugu

SEQ ID NO: 4606 - RNA, 20 nt, Artificial Sequence
  Synthetic
gccucagcuuccugaguaac

SEQ ID NO: 4607 - RNA, 20 nt, Artificial Sequence
  Synthetic
ugagaggauggcuugagccc

SEQ ID NO: 4608 - RNA, 20 nt, Artificial Sequence
  Synthetic
uguaauucuaacacuuuggg

SEQ ID NO: 4609 - RNA, 20 nt, Artificial Sequence
  Synthetic
ccugggcucaagcaauccuc

SEQ ID NO: 4610 - RNA, 20 nt, Artificial Sequence
  Synthetic
gagccaggguuucaccaugu

SEQ ID NO: 4611 - RNA, 20 nt, Artificial Sequence
  Synthetic
gagaaucgauugaacccagg

SEQ ID NO: 4612 - RNA, 20 nt, Artificial Sequence
  Synthetic
gguuucaacauaugaauuuu

SEQ ID NO: 4613 - RNA, 20 nt, Artificial Sequence
  Synthetic
ggagugcaguggugcaauau

SEQ ID NO: 4614 - RNA, 20 nt, Artificial Sequence
  Synthetic
auacaaaaauuagccggcca

SEQ ID NO: 4615 - RNA, 20 nt, Artificial Sequence
  Synthetic
cccaguuacucaggaagcug

SEQ ID NO: 4616 - RNA, 20 nt, Artificial Sequence
  Synthetic
caaaaauuagccggccaugg

SEQ ID NO: 4617 - RNA, 20 nt, Artificial Sequence
  Synthetic
aaauaaaaauuagccaggug

SEQ ID NO: 4618 - RNA, 20 nt, Artificial Sequence
  Synthetic
caggugcauaccaccacacc

SEQ ID NO: 4619 - RNA, 20 nt, Artificial Sequence
  Synthetic
gcacuuugggaagcugagac

SEQ ID NO: 4620 - RNA, 20 nt, Artificial Sequence
  Synthetic
ccucagcuuccugaguaacu

SEQ ID NO: 4621 - RNA, 20 nt, Artificial Sequence
  Synthetic
cuuugggagggcgagguggg

SEQ ID NO: 4622 - RNA, 20 nt, Artificial Sequence
  Synthetic
gcuacuuaagaggcugaggc

SEQ ID NO: 4623 - RNA, 20 nt, Artificial Sequence
  Synthetic
ugggaagacugcuugagccc

SEQ ID NO: 4624 - RNA, 20 nt, Artificial Sequence
  Synthetic
guuucaacauaugaauuuug

SEQ ID NO: 4625 - RNA, 20 nt, Artificial Sequence
  Synthetic
gccucagccucuuaaguagc

SEQ ID NO: 4626 - RNA, 20 nt, Artificial Sequence
  Synthetic
caaggcagguggaucaccua

SEQ ID NO: 4627 - RNA, 20 nt, Artificial Sequence
  Synthetic
uucaacauaugaauuuuggg

SEQ ID NO: 4628 - RNA, 20 nt, Artificial Sequence
  Synthetic
cugccacuguacuccagccu

SEQ ID NO: 4629 - RNA, 20 nt, Artificial Sequence
  Synthetic
uuguguuuuuuguagagaca

SEQ ID NO: 4630 - RNA, 20 nt, Artificial Sequence
  Synthetic
uuucaccaccuuggccaggc

SEQ ID NO: 4631 - RNA, 20 nt, Artificial Sequence
  Synthetic
ucucgcucagucacccaggc

SEQ ID NO: 4632 - RNA, 20 nt, Artificial Sequence
  Synthetic
ugcauuucccaagaccaccc

SEQ ID NO: 4633 - RNA, 20 nt, Artificial Sequence
  Synthetic
ucuuucuuucuuuuuugaga

SEQ ID NO: 4634 - RNA, 20 nt, Artificial Sequence
  Synthetic
ccucagucuuccaaguagcu

SEQ ID NO: 4635 - RNA, 20 nt, Artificial Sequence
  Synthetic
cuuugggaggacaaggcagg

SEQ ID NO: 4636 - RNA, 20 nt, Artificial Sequence
  Synthetic
gagugcaagguuuuauugag

SEQ ID NO: 4637 - RNA, 20 nt, Artificial Sequence
  Synthetic
guaaucucagcacuuuggga

SEQ ID NO: 4638 - RNA, 20 nt, Artificial Sequence
  Synthetic
caaacauuagccaggcaugg

SEQ ID NO: 4639 - RNA, 20 nt, Artificial Sequence
  Synthetic
ugagaccagccugggcagca

SEQ ID NO: 4640 - RNA, 20 nt, Artificial Sequence
  Synthetic
auacaaacauuagccaggca

SEQ ID NO: 4641 - RNA, 20 nt, Artificial Sequence
  Synthetic
uauuauuauuauuuugagac

SEQ ID NO: 4642 - RNA, 20 nt, Artificial Sequence
  Synthetic
cccagcuacuuaagaggcug

SEQ ID NO: 4643 - RNA, 20 nt, Artificial Sequence
  Synthetic
ucacccacacuggagugcag

SEQ ID NO: 4644 - RNA, 20 nt, Artificial Sequence
  Synthetic
gcacuuugggagggcgaggu

SEQ ID NO: 4645 - RNA, 20 nt, Artificial Sequence
  Synthetic
gagacaggguuuugcuaugu

SEQ ID NO: 4646 - RNA, 20 nt, Artificial Sequence
  Synthetic
ccucagccucuuaaguagcu

SEQ ID NO: 4647 - RNA, 20 nt, Artificial Sequence
  Synthetic
aggguuuugcuauguuggcc

SEQ ID NO: 4648 - RNA, 20 nt, Artificial Sequence
  Synthetic
uuuguguuuuuuguagagac

SEQ ID NO: 4649 - RNA, 20 nt, Artificial Sequence
  Synthetic
uuucaacauaugaauuuugg

SEQ ID NO: 4650 - RNA, 20 nt, Artificial Sequence
  Synthetic
ggggccuuugggaggugauu

SEQ ID NO: 4651 - RNA, 20 nt, Artificial Sequence
  Synthetic
aguggaauugcugggucaua

SEQ ID NO: 4652 - RNA, 20 nt, Artificial Sequence
  Synthetic
cacuguagccucaaccuccc

SEQ ID NO: 4653 - RNA, 20 nt, Artificial Sequence
  Synthetic
caaaaaacacaaaaauuagc

SEQ ID NO: 4654 - RNA, 20 nt, Artificial Sequence
  Synthetic
ggaguacaauggcgcgaucu

SEQ ID NO: 4655 - RNA, 20 nt, Artificial Sequence
  Synthetic
uuuuuuuuuucuuuugagac

SEQ ID NO: 4656 - RNA, 20 nt, Artificial Sequence
  Synthetic
uggccaacauggugaaaccc

SEQ ID NO: 4657 - RNA, 20 nt, Artificial Sequence
  Synthetic
cgcuugaacccggaaggcag

SEQ ID NO: 4658 - RNA, 20 nt, Artificial Sequence
  Synthetic
gagacgggguuucaccaggu

SEQ ID NO: 4659 - RNA, 20 nt, Artificial Sequence
  Synthetic
uggggccugucguggggugg

SEQ ID NO: 4660 - RNA, 20 nt, Artificial Sequence
  Synthetic
ucucagcuucccaaagugcu

SEQ ID NO: 4661 - RNA, 20 nt, Artificial Sequence
  Synthetic
cuggggccugucguggggug

SEQ ID NO: 4662 - RNA, 20 nt, Artificial Sequence
  Synthetic
cguuugaaccugggaggcgg

SEQ ID NO: 4663 - RNA, 20 nt, Artificial Sequence
  Synthetic
cacuggggccugucgugggg

SEQ ID NO: 4664 - RNA, 20 nt, Artificial Sequence
  Synthetic
aacuccugaccucaagugau

SEQ ID NO: 4665 - RNA, 20 nt, Artificial Sequence
  Synthetic
caggcuggucuugagcuccu

SEQ ID NO: 4666 - RNA, 20 nt, Artificial Sequence
  Synthetic
cgcgccauuguacuccagcc

SEQ ID NO: 4667 - RNA, 20 nt, Artificial Sequence
  Synthetic
cgcuugaacccgggagaugg

SEQ ID NO: 4668 - RNA, 20 nt, Artificial Sequence
  Synthetic
agagucuuacucugucgccc

SEQ ID NO: 4669 - RNA, 20 nt, Artificial Sequence
  Synthetic
aagaggcugaggcaggagaa

SEQ ID NO: 4670 - RNA, 20 nt, Artificial Sequence
  Synthetic
aaaaaacacaaaaauuagcu

SEQ ID NO: 4671 - RNA, 20 nt, Artificial Sequence
  Synthetic
acuggggccugucguggggu

SEQ ID NO: 4672 - RNA, 20 nt, Artificial Sequence
  Synthetic
gcacuuugggaggacaaggc

SEQ ID NO: 4673 - RNA, 20 nt, Artificial Sequence
  Synthetic
gccuuggccuccugaagugc

SEQ ID NO: 4674 - RNA, 20 nt, Artificial Sequence
  Synthetic
gccuuguccucccaaagugc

SEQ ID NO: 4675 - RNA, 20 nt, Artificial Sequence
  Synthetic
agcacuuugggagggcgagg

SEQ ID NO: 4676 - RNA, 20 nt, Artificial Sequence
  Synthetic
acacacuggggccugucgug

SEQ ID NO: 4677 - RNA, 20 nt, Artificial Sequence
  Synthetic
uggcuguaaucccagcuacu

SEQ ID NO: 4678 - RNA, 20 nt, Artificial Sequence
  Synthetic
caggagaaucacuugaaacc

SEQ ID NO: 4679 - RNA, 20 nt, Artificial Sequence
  Synthetic
ugccugucaucccagcuacu

SEQ ID NO: 4680 - RNA, 20 nt, Artificial Sequence
  Synthetic
cacacacuggggccugucgu

SEQ ID NO: 4681 - RNA, 20 nt, Artificial Sequence
  Synthetic
cagguggaucaccuaagguc

SEQ ID NO: 4682 - RNA, 20 nt, Artificial Sequence
  Synthetic
uguuguuguuguuuuugaga

SEQ ID NO: 4683 - RNA, 20 nt, Artificial Sequence
  Synthetic
ugccucuaaucccagcuacu

SEQ ID NO: 4684 - RNA, 20 nt, Artificial Sequence
  Synthetic
ggagugcaguggagcgaucu

SEQ ID NO: 4685 - RNA, 20 nt, Artificial Sequence
  Synthetic
cccagcacuucaggaggcca

SEQ ID NO: 4686 - RNA, 20 nt, Artificial Sequence
  Synthetic
ggcuguaaucccagcuacuc

SEQ ID NO: 4687 - RNA, 20 nt, Artificial Sequence
  Synthetic
ugcuugagcccaggaggucg

SEQ ID NO: 4688 - RNA, 20 nt, Artificial Sequence
  Synthetic
uuuguauuuuuguagagacg

SEQ ID NO: 4689 - RNA, 20 nt, Artificial Sequence
  Synthetic
ggagucuuacucuguugccc

SEQ ID NO: 4690 - RNA, 20 nt, Artificial Sequence
  Synthetic
ccuuggccuccugaagugcu

SEQ ID NO: 4691 - RNA, 20 nt, Artificial Sequence
  Synthetic
caggagcucaagaccagccu

SEQ ID NO: 4692 - RNA, 20 nt, Artificial Sequence
  Synthetic
ccaggcuggucuugagcucc

SEQ ID NO: 4693 - RNA, 20 nt, Artificial Sequence
  Synthetic
ccaggagcucaagaccagcc

SEQ ID NO: 4694 - RNA, 20 nt, Artificial Sequence
  Synthetic
gaauuucacucuuguugccc

SEQ ID NO: 4695 - RNA, 20 nt, Artificial Sequence
  Synthetic
cgauaguuugcucagaauga

SEQ ID NO: 4696 - RNA, 20 nt, Artificial Sequence
  Synthetic
cccagcacuuugggaggaca

SEQ ID NO: 4697 - RNA, 20 nt, Artificial Sequence
  Synthetic
auucugagcaaacuaucgca

SEQ ID NO: 4698 - RNA, 20 nt, Artificial Sequence
  Synthetic
cuaaagauacaaaaauuagc

SEQ ID NO: 4699 - RNA, 20 nt, Artificial Sequence
  Synthetic
ccuuguccucccaaagugcu

SEQ ID NO: 4700 - RNA, 20 nt, Artificial Sequence
  Synthetic
cgcuccacugcacuccagcc

SEQ ID NO: 4701 - RNA, 20 nt, Artificial Sequence
  Synthetic
gcgccauuguacuccagccu

SEQ ID NO: 4702 - RNA, 20 nt, Artificial Sequence
  Synthetic
aucucaaaaaaaaaaaaaaa

SEQ ID NO: 4703 - RNA, 20 nt, Artificial Sequence
  Synthetic
gagcggggagggauagcauu

SEQ ID NO: 4704 - RNA, 20 nt, Artificial Sequence
  Synthetic
ucaagcgauucuccugccuc

SEQ ID NO: 4705 - RNA, 20 nt, Artificial Sequence
  Synthetic
uuaauccagucuaucacuga

SEQ ID NO: 4706 - RNA, 20 nt, Artificial Sequence
  Synthetic
gagaaucgcuugaacccgga

SEQ ID NO: 4707 - RNA, 20 nt, Artificial Sequence
  Synthetic
gccucuaaucccagcuacuc

SEQ ID NO: 4708 - RNA, 20 nt, Artificial Sequence
  Synthetic
uuguaauuuuaguagagacg

SEQ ID NO: 4709 - RNA, 20 nt, Artificial Sequence
  Synthetic
aaucgcuugaacccgggaga

SEQ ID NO: 4710 - RNA, 20 nt, Artificial Sequence
  Synthetic
uuuugcuauguuggccaggc

SEQ ID NO: 4711 - RNA, 20 nt, Artificial Sequence
  Synthetic
uaaaaauacaaacauuagcc

SEQ ID NO: 4712 - RNA, 20 nt, Artificial Sequence
  Synthetic
ucacacacuggggccugucg

SEQ ID NO: 4713 - RNA, 20 nt, Artificial Sequence
  Synthetic
ccauguuggucaggcugguc

SEQ ID NO: 4714 - RNA, 20 nt, Artificial Sequence
  Synthetic
ccagaccagccugaccaaca

SEQ ID NO: 4715 - RNA, 20 nt, Artificial Sequence
  Synthetic
ugacuguaaucccagcacuu

SEQ ID NO: 4716 - RNA, 20 nt, Artificial Sequence
  Synthetic
caggcuggucucaaauuccu

SEQ ID NO: 4717 - RNA, 20 nt, Artificial Sequence
  Synthetic
ugggaggaucccuugagccc

SEQ ID NO: 4718 - RNA, 20 nt, Artificial Sequence
  Synthetic
ugcaccacugcacuccaguc

SEQ ID NO: 4719 - RNA, 20 nt, Artificial Sequence
  Synthetic
ucuuacucugucgcccaggc

SEQ ID NO: 4720 - RNA, 20 nt, Artificial Sequence
  Synthetic
ucucacucuguugcccagac

SEQ ID NO: 4721 - RNA, 20 nt, Artificial Sequence
  Synthetic
aacugcuugaacccaggagg

SEQ ID NO: 4722 - RNA, 20 nt, Artificial Sequence
  Synthetic
acacaaaaauuagcugggca

SEQ ID NO: 4723 - RNA, 20 nt, Artificial Sequence
  Synthetic
ggauuacaggcgugagccac

SEQ ID NO: 4724 - RNA, 20 nt, Artificial Sequence
  Synthetic
gccgaggugggcggaucaug

SEQ ID NO: 4725 - RNA, 20 nt, Artificial Sequence
  Synthetic
cagaaguuugagaccagccu

SEQ ID NO: 4726 - RNA, 20 nt, Artificial Sequence
  Synthetic
gaggucucacuauguugccc

SEQ ID NO: 4727 - RNA, 20 nt, Artificial Sequence
  Synthetic
uuuuguauuuuuguagagac

SEQ ID NO: 4728 - RNA, 20 nt, Artificial Sequence
  Synthetic
ucgggaguucgagaccagcc

SEQ ID NO: 4729 - RNA, 20 nt, Artificial Sequence
  Synthetic
ugccuguaaccccagcacuu

SEQ ID NO: 4730 - RNA, 20 nt, Artificial Sequence
  Synthetic
uuuguaauuuuaguagagac

SEQ ID NO: 4731 - RNA, 20 nt, Artificial Sequence
  Synthetic
gcuccacugcacuccagccu

SEQ ID NO: 4732 - RNA, 20 nt, Artificial Sequence
  Synthetic
gcaggcagaucaccugaggu

SEQ ID NO: 4733 - RNA, 20 nt, Artificial Sequence
  Synthetic
uccugaguaacugggauuac

SEQ ID NO: 4734 - RNA, 20 nt, Artificial Sequence
  Synthetic
cuuggccucccaaagugcug

SEQ ID NO: 4735 - RNA, 20 nt, Artificial Sequence
  Synthetic
caggugugugccaccacacc

SEQ ID NO: 4736 - RNA, 20 nt, Artificial Sequence
  Synthetic
ccaggcuggucucaaauucc

SEQ ID NO: 4737 - RNA, 20 nt, Artificial Sequence
  Synthetic
ccaggaauuugagaccagcc

SEQ ID NO: 4738 - RNA, 20 nt, Artificial Sequence
  Synthetic
uuuuuguauuuuuguagaga

SEQ ID NO: 4739 - RNA, 20 nt, Artificial Sequence
  Synthetic
uguaaucccagcacuucagg

SEQ ID NO: 4740 - RNA, 20 nt, Artificial Sequence
  Synthetic
gagaacugcuugaacccagg

SEQ ID NO: 4741 - RNA, 20 nt, Artificial Sequence
  Synthetic
caggaauuugagaccagccu

SEQ ID NO: 4742 - RNA, 20 nt, Artificial Sequence
  Synthetic
ucagaaguuugagaccagcc

SEQ ID NO: 4743 - RNA, 20 nt, Artificial Sequence
  Synthetic
gacuguaaucccagcacuuu

SEQ ID NO: 4744 - RNA, 20 nt, Artificial Sequence
  Synthetic
gcaccacugcacuccagucu

SEQ ID NO: 4745 - RNA, 20 nt, Artificial Sequence
  Synthetic
uaaaaauuagccaggugugg

SEQ ID NO: 4746 - RNA, 20 nt, Artificial Sequence
  Synthetic
uuuuguaauuuuaguagaga

SEQ ID NO: 4747 - RNA, 20 nt, Artificial Sequence
  Synthetic
uaaaaauacaaaaaucagcu

SEQ ID NO: 4748 - RNA, 20 nt, Artificial Sequence
  Synthetic
gccucggucucccaaagugc

SEQ ID NO: 4749 - RNA, 20 nt, Artificial Sequence
  Synthetic
gcacuuugggagaccgaggc

SEQ ID NO: 4750 - RNA, 20 nt, Artificial Sequence
  Synthetic
agcacuuugggagaccgagg

SEQ ID NO: 4751 - RNA, 20 nt, Artificial Sequence
  Synthetic
accucaugauccgcccaccu

SEQ ID NO: 4752 - RNA, 20 nt, Artificial Sequence
  Synthetic
cacugcaaccucugccuucc

SEQ ID NO: 4753 - RNA, 20 nt, Artificial Sequence
  Synthetic
ucuuacucuguugcccaggc

SEQ ID NO: 4754 - RNA, 20 nt, Artificial Sequence
  Synthetic
cacugcagccucgaccuccu

SEQ ID NO: 4755 - RNA, 20 nt, Artificial Sequence
  Synthetic
aaaaaaaaaaaaaaaaagcc

SEQ ID NO: 4756 - RNA, 20 nt, Artificial Sequence
  Synthetic
gggguuucuccauguuggcc

SEQ ID NO: 4757 - RNA, 20 nt, Artificial Sequence
  Synthetic
caggagaacugcuugaaccc

SEQ ID NO: 4758 - RNA, 20 nt, Artificial Sequence
  Synthetic
ggugggcggaucaugagguc

SEQ ID NO: 4759 - RNA, 20 nt, Artificial Sequence
  Synthetic
uugcccaggcuggaguacaa

SEQ ID NO: 4760 - RNA, 20 nt, Artificial Sequence
  Synthetic
ucacugcagccucgaccucc

SEQ ID NO: 4761 - RNA, 20 nt, Artificial Sequence
  Synthetic
ucacugcaaccucugccuuc

SEQ ID NO: 4762 - RNA, 20 nt, Artificial Sequence
  Synthetic
gggauuacaggcgugagcca

SEQ ID NO: 4763 - RNA, 20 nt, Artificial Sequence
  Synthetic
gccuguagucccagcuacua

SEQ ID NO: 4764 - RNA, 20 nt, Artificial Sequence
  Synthetic
cuaaaaauacaaaaaucagc

SEQ ID NO: 4765 - RNA, 20 nt, Artificial Sequence
  Synthetic
caggcgcccgccaccacacc

SEQ ID NO: 4766 - RNA, 20 nt, Artificial Sequence
  Synthetic
cccagcacuuugggagaccg

SEQ ID NO: 4767 - RNA, 20 nt, Artificial Sequence
  Synthetic
uugcccagacuggagugcag

SEQ ID NO: 4768 - RNA, 20 nt, Artificial Sequence
  Synthetic
caaaaaaaaaaaaaaaaaaa

SEQ ID NO: 4769 - RNA, 20 nt, Artificial Sequence
  Synthetic
acacuuugggaggcugaggu

SEQ ID NO: 4770 - RNA, 20 nt, Artificial Sequence
  Synthetic
ccucggucucccaaagugcu

SEQ ID NO: 4771 - RNA, 20 nt, Artificial Sequence
  Synthetic
ucacugcagccuugaacucc

SEQ ID NO: 4772 - RNA, 20 nt, Artificial Sequence
  Synthetic
aaaaaaaaaaaaaaaaaaga

SEQ ID NO: 4773 - RNA, 20 nt, Artificial Sequence
  Synthetic
gccuguaaccccagcacuuu

SEQ ID NO: 4774 - RNA, 20 nt, Artificial Sequence
  Synthetic
auuauuauacuuuaaguucu

SEQ ID NO: 4775 - RNA, 20 nt, Artificial Sequence
  Synthetic
uuguauuuuuaguagagacu

SEQ ID NO: 4776 - RNA, 20 nt, Artificial Sequence
  Synthetic
ucgcccaggcuggaguacag

SEQ ID NO: 4777 - RNA, 20 nt, Artificial Sequence
  Synthetic
cgaggcaggcagaucaccug

SEQ ID NO: 4778 - RNA, 20 nt, Artificial Sequence
  Synthetic
cgaggcaggcagaucaccug

SEQ ID NO: 4779 - RNA, 20 nt, Artificial Sequence
  Synthetic
ucccuaguagcugggacuac

SEQ ID NO: 4780 - RNA, 20 nt, Artificial Sequence
  Synthetic
uuucuccauguuggccaggc

SEQ ID NO: 4781 - RNA, 20 nt, Artificial Sequence
  Synthetic
aauacaaaauuagccaggca

SEQ ID NO: 4782 - RNA, 20 nt, Artificial Sequence
  Synthetic
uguagucccagcuacuaggg

SEQ ID NO: 4783 - RNA, 20 nt, Artificial Sequence
  Synthetic
ggagugcaauggcgcaaucu

SEQ ID NO: 4784 - RNA, 20 nt, Artificial Sequence
  Synthetic
acaaaauuagccaggcaugg

SEQ ID NO: 4785 - RNA, 20 nt, Artificial Sequence
  Synthetic
aauggugugaacccgggagg

SEQ ID NO: 4786 - RNA, 20 nt, Artificial Sequence
  Synthetic
uucuccugccucagccuccc

SEQ ID NO: 4787 - RNA, 20 nt, Artificial Sequence
  Synthetic
ucaggaguuccagaccagcc

SEQ ID NO: 4788 - RNA, 20 nt, Artificial Sequence
  Synthetic
ucccaaagugcugggguuac

SEQ ID NO: 4789 - RNA, 20 nt, Artificial Sequence
  Synthetic
uguaaccccagcacuuuggg

SEQ ID NO: 4790 - RNA, 20 nt, Artificial Sequence
  Synthetic
aaaaaaaaaaaaaaaaaaag

SEQ ID NO: 4791 - RNA, 20 nt, Artificial Sequence
  Synthetic
uacaaaaaauuagccgggug

SEQ ID NO: 4792 - RNA, 20 nt, Artificial Sequence
  Synthetic
caggugugagccaccacacc

SEQ ID NO: 4793 - RNA, 20 nt, Artificial Sequence
  Synthetic
aacacuuugggaggcugagg

SEQ ID NO: 4794 - RNA, 20 nt, Artificial Sequence
  Synthetic
ggucucgaacucccgaccuc

SEQ ID NO: 4795 - RNA, 20 nt, Artificial Sequence
  Synthetic
uacaaaaaauuagccaggug

SEQ ID NO: 4796 - RNA, 20 nt, Artificial Sequence
  Synthetic
caggcaugagccaccgcacc

SEQ ID NO: 4797 - RNA, 20 nt, Artificial Sequence
  Synthetic
ugcgccauugcacuccagcc

SEQ ID NO: 4798 - RNA, 20 nt, Artificial Sequence
  Synthetic
uuauuauacuuuaaguucua

SEQ ID NO: 4799 - RNA, 20 nt, Artificial Sequence
  Synthetic
gagaauggugugaacccggg

SEQ ID NO: 4800 - RNA, 20 nt, Artificial Sequence
  Synthetic
aauuagccgggugugguggc

SEQ ID NO: 4801 - RNA, 20 nt, Artificial Sequence
  Synthetic
caccgcauguucucacucau

SEQ ID NO: 4802 - RNA, 20 nt, Artificial Sequence
  Synthetic
caaggcagguggaucaccug

SEQ ID NO: 4803 - RNA, 20 nt, Artificial Sequence
  Synthetic
cgcauguucucacucauagg

SEQ ID NO: 4804 - RNA, 20 nt, Artificial Sequence
  Synthetic
aaauuagccggguguggugg

SEQ ID NO: 4805 - RNA, 20 nt, Artificial Sequence
  Synthetic
cgccuguaaucucagcacuu

SEQ ID NO: 4806 - RNA, 20 nt, Artificial Sequence
  Synthetic
cucaggugaucugccugccu

SEQ ID NO: 4807 - RNA, 20 nt, Artificial Sequence
  Synthetic
cucaggugaucugccugccu

SEQ ID NO: 4808 - RNA, 20 nt, Artificial Sequence
  Synthetic
gcuacuagggaggcugaggc

SEQ ID NO: 4809 - RNA, 20 nt, Artificial Sequence
  Synthetic
ugcuugaacccaggaggcgg

SEQ ID NO: 4810 - RNA, 20 nt, Artificial Sequence
  Synthetic
gccucagccucccuaguagc

SEQ ID NO: 4811 - RNA, 20 nt, Artificial Sequence
  Synthetic
gagacgggguuucuccaugu

SEQ ID NO: 4812 - RNA, 20 nt, Artificial Sequence
  Synthetic
gagugagaacaugcgguguu

SEQ ID NO: 4813 - RNA, 20 nt, Artificial Sequence
  Synthetic
gguacaugugcacaacgugc

SEQ ID NO: 4814 - RNA, 20 nt, Artificial Sequence
  Synthetic
aaaaaauuagccgggugugg

SEQ ID NO: 4815 - RNA, 20 nt, Artificial Sequence
  Synthetic
ccuagcacuuugggaggccg

SEQ ID NO: 4816 - RNA, 20 nt, Artificial Sequence
  Synthetic
caggcgugagccacugugcc

SEQ ID NO: 4817 - RNA, 20 nt, Artificial Sequence
  Synthetic
cccagcuacuagggaggcug

SEQ ID NO: 4818 - RNA, 20 nt, Artificial Sequence
  Synthetic
cccagcuacuagggaggcug

SEQ ID NO: 4819 - RNA, 20 nt, Artificial Sequence
  Synthetic
cgccuguaauccuagcacuu

SEQ ID NO: 4820 - RNA, 20 nt, Artificial Sequence
  Synthetic
uguagggacauggaugaagc

SEQ ID NO: 4821 - RNA, 20 nt, Artificial Sequence
  Synthetic
ccucagccucccuaguagcu

SEQ ID NO: 4822 - RNA, 20 nt, Artificial Sequence
  Synthetic
ccucagccucccuaguagcu

SEQ ID NO: 4823 - RNA, 20 nt, Artificial Sequence
  Synthetic
ugccuguaauccuagcacuu

SEQ ID NO: 4824 - RNA, 20 nt, Artificial Sequence
  Synthetic
caggcagaucaccugagguc

SEQ ID NO: 4825 - RNA, 20 nt, Artificial Sequence
  Synthetic
caggcagaucaccugagguc

SEQ ID NO: 4826 - RNA, 20 nt, Artificial Sequence
  Synthetic
gcauguucucacucauaggu

SEQ ID NO: 4827 - RNA, 20 nt, Artificial Sequence
  Synthetic
caccuaugagugagaacaug

SEQ ID NO: 4828 - RNA, 20 nt, Artificial Sequence
  Synthetic
gcaggagaauggugugaacc

SEQ ID NO: 4829 - RNA, 20 nt, Artificial Sequence
  Synthetic
caggcaugagccaccaugcc

SEQ ID NO: 4830 - RNA, 20 nt, Artificial Sequence
  Synthetic
caggagaauggugugaaccc

SEQ ID NO: 4831 - RNA, 20 nt, Artificial Sequence
  Synthetic
caugccauugcacuccagcc

SEQ ID NO: 4832 - RNA, 20 nt, Artificial Sequence
  Synthetic
ucucacuauguugcccaggc

SEQ ID NO: 4833 - RNA, 20 nt, Artificial Sequence
  Synthetic
augccauugcacuccagccu

SEQ ID NO: 4834 - RNA, 20 nt, Artificial Sequence
  Synthetic
aaaaaauuagccaggugugg

SEQ ID NO: 4835 - RNA, 20 nt, Artificial Sequence
  Synthetic
uauguauacaugugccaugu

SEQ ID NO: 4836 - RNA, 20 nt, Artificial Sequence
  Synthetic
gggguuucacuguguuagcc

SEQ ID NO: 4837 - RNA, 20 nt, Artificial Sequence
  Synthetic
gaguuucacucuuguugccc

SEQ ID NO: 4838 - RNA, 20 nt, Artificial Sequence
  Synthetic
cucaggugauccaccugccu

SEQ ID NO: 4839 - RNA, 20 nt, Artificial Sequence
  Synthetic
uucacucuuguugcccaggc

SEQ ID NO: 4840 - RNA, 20 nt, Artificial Sequence
  Synthetic
uucacucuuguugcccaggc

SEQ ID NO: 4841 - RNA, 20 nt, Artificial Sequence
  Synthetic
gccuguaaucucagcacuuu

SEQ ID NO: 4842 - RNA, 20 nt, Artificial Sequence
  Synthetic
gcgccauugcacuccagccu

SEQ ID NO: 4843 - RNA, 20 nt, Artificial Sequence
  Synthetic
gggguuucaccauguugguc

SEQ ID NO: 4844 - RNA, 20 nt, Artificial Sequence
  Synthetic
accucagccuccugaguagc

SEQ ID NO: 4845 - RNA, 20 nt, Artificial Sequence
  Synthetic
agcuacucaggaggcugagg

SEQ ID NO: 4846 - RNA, 20 nt, Artificial Sequence
  Synthetic
agcuacucaggaggcugagg

SEQ ID NO: 4847 - RNA, 20 nt, Artificial Sequence
  Synthetic
gcuacucaggaggcugaggu

SEQ ID NO: 4848 - RNA, 20 nt, Artificial Sequence
  Synthetic
uuuuuuuuuuuuuuugagac

SEQ ID NO: 4849 - RNA, 20 nt, Artificial Sequence
  Synthetic
uuuuuuuuuuuuuuugagac

SEQ ID NO: 4850 - RNA, 20 nt, Artificial Sequence
  Synthetic
uuuuuuuuuuuuuugagaca

SEQ ID NO: 4851 - RNA, 20 nt, Artificial Sequence
  Synthetic
uuuuuuuuuuuuuugagaca

SEQ ID NO: 4852 - RNA, 20 nt, Artificial Sequence
  Synthetic
uuucacuguguuagccagga

SEQ ID NO: 4853 - RNA, 20 nt, Artificial Sequence
  Synthetic
ucacccaggcuggagugcaa

SEQ ID NO: 4854 - RNA, 20 nt, Artificial Sequence
  Synthetic
accuguaaucccagcuacuu

SEQ ID NO: 4855 - RNA, 20 nt, Artificial Sequence
  Synthetic
cuaaaaauacaaaauuagcc

SEQ ID NO: 4856 - RNA, 20 nt, Artificial Sequence
  Synthetic
gccuguaauccuagcacuuu

SEQ ID NO: 4857 - RNA, 20 nt, Artificial Sequence
  Synthetic
gccuguaauccuagcacuuu

SEQ ID NO: 4858 - RNA, 20 nt, Artificial Sequence
  Synthetic
ggagugcaguggcgugaucu

SEQ ID NO: 4859 - RNA, 20 nt, Artificial Sequence
  Synthetic
ggagugcaguggcgugaucu

SEQ ID NO: 4860 - RNA, 20 nt, Artificial Sequence
  Synthetic
ucccaaagugcugagauuac

SEQ ID NO: 4861 - RNA, 20 nt, Artificial Sequence
  Synthetic
uguaaucucagcacuuuggg

SEQ ID NO: 4862 - RNA, 20 nt, Artificial Sequence
  Synthetic
uagacuggauuaagaaaaug

SEQ ID NO: 4863 - RNA, 20 nt, Artificial Sequence
  Synthetic
uuucaccauguuggucaggc

SEQ ID NO: 4864 - RNA, 20 nt, Artificial Sequence
  Synthetic
cacugcaaccuccgccuccu

SEQ ID NO: 4865 - RNA, 20 nt, Artificial Sequence
  Synthetic
ggagucucgcucugucgccc

SEQ ID NO: 4866 - RNA, 20 nt, Artificial Sequence
  Synthetic
aauguggcacauauacacca

SEQ ID NO: 4867 - RNA, 20 nt, Artificial Sequence
  Synthetic
acgccacugcacuccagccu

SEQ ID NO: 4868 - RNA, 20 nt, Artificial Sequence
  Synthetic
ucccaaagugcuaggauuac

SEQ ID NO: 4869 - RNA, 20 nt, Artificial Sequence
  Synthetic
ucccaaagugcuaggauuac

SEQ ID NO: 4870 - RNA, 20 nt, Artificial Sequence
  Synthetic
ggagugcaguggcgcgaucu

SEQ ID NO: 4871 - RNA, 20 nt, Artificial Sequence
  Synthetic
cacgccacugcacuccagcc

SEQ ID NO: 4872 - RNA, 20 nt, Artificial Sequence
  Synthetic
uguaauccuagcacuuuggg

SEQ ID NO: 4873 - RNA, 20 nt, Artificial Sequence
  Synthetic
caaaaauuagcugggcaugg

SEQ ID NO: 4874 - RNA, 20 nt, Artificial Sequence
  Synthetic
cuuugggaggcugagguggg

SEQ ID NO: 4875 - RNA, 20 nt, Artificial Sequence
  Synthetic
ggucucaaacuccugaccuc

SEQ ID NO: 4876 - RNA, 20 nt, Artificial Sequence
  Synthetic
gagaaucgcuugaacccagg

SEQ ID NO: 4877 - RNA, 20 nt, Artificial Sequence
  Synthetic
caggcgugagccaccgcgcc

SEQ ID NO: 4878 - RNA, 20 nt, Artificial Sequence
  Synthetic
cuuugggaggccaaggcagg

SEQ ID NO: 4879 - RNA, 20 nt, Artificial Sequence
  Synthetic
ggucuugaacuccugaccuc

SEQ ID NO: 4880 - RNA, 20 nt, Artificial Sequence
  Synthetic
ucucgcucugucgcccaggc

SEQ ID NO: 4881 - RNA, 20 nt, Artificial Sequence
  Synthetic
cuuugggaggccgagguggg

SEQ ID NO: 4882 - RNA, 20 nt, Artificial Sequence
  Synthetic
caccuguaaucccagcuacu

SEQ ID NO: 4883 - RNA, 20 nt, Artificial Sequence
  Synthetic
cgcgccacugcacuccagcc

SEQ ID NO: 4884 - RNA, 20 nt, Artificial Sequence
  Synthetic
accuguagucccagcuacuc

SEQ ID NO: 4885 - RNA, 20 nt, Artificial Sequence
  Synthetic
aggguuucaccauguuggcc

SEQ ID NO: 4886 - RNA, 20 nt, Artificial Sequence
  Synthetic
cacugcaagcuccgccuccc

SEQ ID NO: 4887 - RNA, 20 nt, Artificial Sequence
  Synthetic
ugccuguagucccagcuacu

SEQ ID NO: 4888 - RNA, 20 nt, Artificial Sequence
  Synthetic
ggucucgaacuccugaccuc

SEQ ID NO: 4889 - RNA, 20 nt, Artificial Sequence
  Synthetic
ucacugcaagcuccgccucc

SEQ ID NO: 4890 - RNA, 20 nt, Artificial Sequence
  Synthetic
cacugcaaccuccgccuccc

SEQ ID NO: 4891 - RNA, 20 nt, Artificial Sequence
  Synthetic
gcacuuugggaggccgaggu

SEQ ID NO: 4892 - RNA, 20 nt, Artificial Sequence
  Synthetic
ucacugcaaccuccgccucc

SEQ ID NO: 4893 - RNA, 20 nt, Artificial Sequence
  Synthetic
caagaccagccuggccaaca

SEQ ID NO: 4894 - RNA, 20 nt, Artificial Sequence
  Synthetic
gagaugggguuucaccaugu

SEQ ID NO: 4895 - RNA, 20 nt, Artificial Sequence
  Synthetic
uguagucccagcuacucagg

SEQ ID NO: 4896 - RNA, 20 nt, Artificial Sequence
  Synthetic
uguagucccagcuacucagg

SEQ ID NO: 4897 - RNA, 20 nt, Artificial Sequence
  Synthetic
uccugaguagcugggacuac

SEQ ID NO: 4898 - RNA, 20 nt, Artificial Sequence
  Synthetic
uccugaguagcugggacuac

SEQ ID NO: 4899 - RNA, 20 nt, Artificial Sequence
  Synthetic
caggagaaucgcuugaaccc

SEQ ID NO: 4900 - RNA, 20 nt, Artificial Sequence
  Synthetic
caggagaaucgcuugaaccc

SEQ ID NO: 4901 - RNA, 20 nt, Artificial Sequence
  Synthetic
cgagaccagccuggccaaca

SEQ ID NO: 4902 - RNA, 20 nt, Artificial Sequence
  Synthetic
gcaggagaaucgcuugaacc

SEQ ID NO: 4903 - RNA, 20 nt, Artificial Sequence
  Synthetic
gcaggagaaucgcuugaacc

SEQ ID NO: 4904 - RNA, 20 nt, Artificial Sequence
  Synthetic
uguaaucccagcuacucggg

SEQ ID NO: 4905 - RNA, 20 nt, Artificial Sequence
  Synthetic
uaaaaauacaaaaaauuagc

SEQ ID NO: 4906 - RNA, 20 nt, Artificial Sequence
  Synthetic
gcgccacugcacuccagccu

SEQ ID NO: 4907 - RNA, 20 nt, Artificial Sequence
  Synthetic
ucccaaguagcugggauuac

SEQ ID NO: 4908 - RNA, 20 nt, Artificial Sequence
  Synthetic
uguaaucccagcuacuuggg

SEQ ID NO: 4909 - RNA, 20 nt, Artificial Sequence
  Synthetic
ucaggaguucaagaccagcc

SEQ ID NO: 4910 - RNA, 20 nt, Artificial Sequence
  Synthetic
ucaggaguucgagaccagcc

SEQ ID NO: 4911 - RNA, 20 nt, Artificial Sequence
  Synthetic
ucaggaguucgagaccagcc

SEQ ID NO: 4912 - RNA, 20 nt, Artificial Sequence
  Synthetic
aaaaauacaaaaaauuagcc

SEQ ID NO: 4913 - RNA, 20 nt, Artificial Sequence
  Synthetic
aaaaauacaaaaaauuagcc

SEQ ID NO: 4914 - RNA, 20 nt, Artificial Sequence
  Synthetic
ucaggagaucgagaccaucc

SEQ ID NO: 4915 - RNA, 20 nt, Artificial Sequence
  Synthetic
gccuuggccucccaaagugc

SEQ ID NO: 4916 - RNA, 20 nt, Artificial Sequence
  Synthetic
gccuuggccucccaaagugc

SEQ ID NO: 4917 - RNA, 20 nt, Artificial Sequence
  Synthetic
gcacuuugggaggccaaggc

SEQ ID NO: 4918 - RNA, 20 nt, Artificial Sequence
  Synthetic
gcacuuugggaggccaaggc

SEQ ID NO: 4919 - RNA, 20 nt, Artificial Sequence
  Synthetic
gccucagccucccaaagugc

SEQ ID NO: 4920 - RNA, 20 nt, Artificial Sequence
  Synthetic
gcacuuugggaggcugaggc

SEQ ID NO: 4921 - RNA, 20 nt, Artificial Sequence
  Synthetic
agcacuuugggaggcugagg

SEQ ID NO: 4922 - RNA, 20 nt, Artificial Sequence
  Synthetic
ucgcccaggcuggagugcag

SEQ ID NO: 4923 - RNA, 20 nt, Artificial Sequence
  Synthetic
ucgcccaggcuggagugcag

SEQ ID NO: 4924 - RNA, 20 nt, Artificial Sequence
  Synthetic
uuguauuuuuaguagagaca

SEQ ID NO: 4925 - RNA, 20 nt, Artificial Sequence
  Synthetic
uuguauuuuuaguagagaca

SEQ ID NO: 4926 - RNA, 20 nt, Artificial Sequence
  Synthetic
uugcccaggcuggagugcag

SEQ ID NO: 4927 - RNA, 20 nt, Artificial Sequence
  Synthetic
caccuguaaucccagcacuu

SEQ ID NO: 4928 - RNA, 20 nt, Artificial Sequence
  Synthetic
gccuguagucccagcuacuc

SEQ ID NO: 4929 - RNA, 20 nt, Artificial Sequence
  Synthetic
accuguaaucccagcacuuu

SEQ ID NO: 4930 - RNA, 20 nt, Artificial Sequence
  Synthetic
gcuacuugggaggcugaggc

SEQ ID NO: 4931 - RNA, 20 nt, Artificial Sequence
  Synthetic
gcuacucaggaggcugaggc

SEQ ID NO: 4932 - RNA, 20 nt, Artificial Sequence
  Synthetic
cccagcacuuugggaggcca

SEQ ID NO: 4933 - RNA, 20 nt, Artificial Sequence
  Synthetic
cccagcacuuugggaggcca

SEQ ID NO: 4934 - RNA, 20 nt, Artificial Sequence
  Synthetic
gccucagccucccaaguagc

SEQ ID NO: 4935 - RNA, 20 nt, Artificial Sequence
  Synthetic
gccucggccucccaaagugc

SEQ ID NO: 4936 - RNA, 20 nt, Artificial Sequence
  Synthetic
gccucggccucccaaagugc

SEQ ID NO: 4937 - RNA, 20 nt, Artificial Sequence
  Synthetic
uuguauuuuuaguagagaug

SEQ ID NO: 4938 - RNA, 20 nt, Artificial Sequence
  Synthetic
uuuuuuuuuuuuuuuugaga

SEQ ID NO: 4939 - RNA, 20 nt, Artificial Sequence
  Synthetic
uuuuuuuuuuuuuuuugaga

SEQ ID NO: 4940 - RNA, 20 nt, Artificial Sequence
  Synthetic
ccuuggccucccaaagugcu

SEQ ID NO: 4941 - RNA, 20 nt, Artificial Sequence
  Synthetic
ccuuggccucccaaagugcu

SEQ ID NO: 4942 - RNA, 20 nt, Artificial Sequence
  Synthetic
cccagcacuuugggaggcug

SEQ ID NO: 4943 - RNA, 20 nt, Artificial Sequence
  Synthetic
gcacuuugggaggccgaggc

SEQ ID NO: 4944 - RNA, 20 nt, Artificial Sequence
  Synthetic
gcacuuugggaggccgaggc

SEQ ID NO: 4945 - RNA, 20 nt, Artificial Sequence
  Synthetic
gccucagccuccugaguagc

SEQ ID NO: 4946 - RNA, 20 nt, Artificial Sequence
  Synthetic
uuuguauuuuuaguagagau

SEQ ID NO: 4947 - RNA, 20 nt, Artificial Sequence
  Synthetic
uuucaccauguuggccaggc

SEQ ID NO: 4948 - RNA, 20 nt, Artificial Sequence
  Synthetic
gcuacucgggaggcugaggc

SEQ ID NO: 4949 - RNA, 20 nt, Artificial Sequence
  Synthetic
agcacuuugggaggccgagg

SEQ ID NO: 4950 - RNA, 20 nt, Artificial Sequence
  Synthetic
cccagcuacuugggaggcug

SEQ ID NO: 4951 - RNA, 20 nt, Artificial Sequence
  Synthetic
ugccuguaaucccagcacuu

SEQ ID NO: 4952 - RNA, 20 nt, Artificial Sequence
  Synthetic
ccucagccucccaaagugcu

SEQ ID NO: 4953 - RNA, 20 nt, Artificial Sequence
  Synthetic
ccucagccucccaaguagcu

SEQ ID NO: 4954 - RNA, 20 nt, Artificial Sequence
  Synthetic
cccagcuacucaggaggcug

SEQ ID NO: 4955 - RNA, 20 nt, Artificial Sequence
  Synthetic
cccagcuacucaggaggcug

SEQ ID NO: 4956 - RNA, 20 nt, Artificial Sequence
  Synthetic
gccucagccucccgaguagc

SEQ ID NO: 4957 - RNA, 20 nt, Artificial Sequence
  Synthetic
ccucagccuccugaguagcu

SEQ ID NO: 4958 - RNA, 20 nt, Artificial Sequence
  Synthetic
ccucagccuccugaguagcu

SEQ ID NO: 4959 - RNA, 20 nt, Artificial Sequence
  Synthetic
cccagcuacucgggaggcug

SEQ ID NO: 4960 - RNA, 20 nt, Artificial Sequence
  Synthetic
uuguauuuuuaguagagacg

SEQ ID NO: 4961 - RNA, 20 nt, Artificial Sequence
  Synthetic
ccucagccucccgaguagcu

SEQ ID NO: 4962 - RNA, 20 nt, Artificial Sequence
  Synthetic
cccagcacuuugggaggccg

SEQ ID NO: 4963 - RNA, 20 nt, Artificial Sequence
  Synthetic
cccagcacuuugggaggccg

SEQ ID NO: 4964 - RNA, 20 nt, Artificial Sequence
  Synthetic
ccucggccucccaaagugcu

SEQ ID NO: 4965 - RNA, 20 nt, Artificial Sequence
  Synthetic
ccucggccucccaaagugcu

SEQ ID NO: 4966 - RNA, 20 nt, Artificial Sequence
  Synthetic
ccucggccucccaaagugcu

SEQ ID NO: 4967 - RNA, 20 nt, Artificial Sequence
  Synthetic
cgccuguaaucccagcacuu

SEQ ID NO: 4968 - RNA, 20 nt, Artificial Sequence
  Synthetic
cgccuguaaucccagcacuu

SEQ ID NO: 4969 - RNA, 20 nt, Artificial Sequence
  Synthetic
cgccuguaaucccagcacuu

SEQ ID NO: 4970 - RNA, 20 nt, Artificial Sequence
  Synthetic
uuuguauuuuuaguagagac

SEQ ID NO: 4971 - RNA, 20 nt, Artificial Sequence
  Synthetic
uuuguauuuuuaguagagac

SEQ ID NO: 4972 - RNA, 20 nt, Artificial Sequence
  Synthetic
uuuguauuuuuaguagagac

SEQ ID NO: 4973 - RNA, 20 nt, Artificial Sequence
  Synthetic
uuuguauuuuuaguagagac

SEQ ID NO: 4974 - RNA, 20 nt, Artificial Sequence
  Synthetic
uuuuguauuuuuaguagaga

SEQ ID NO: 4975 - RNA, 20 nt, Artificial Sequence
  Synthetic
uuuuguauuuuuaguagaga

SEQ ID NO: 4976 - RNA, 20 nt, Artificial Sequence
  Synthetic
gccuguaaucccagcacuuu

SEQ ID NO: 4977 - RNA, 20 nt, Artificial Sequence
  Synthetic
gccuguaaucccagcacuuu

SEQ ID NO: 4978 - RNA, 20 nt, Artificial Sequence
  Synthetic
gccuguaaucccagcacuuu

SEQ ID NO: 4979 - RNA, 20 nt, Artificial Sequence
  Synthetic
gccuguaaucccagcacuuu

SEQ ID NO: 4980 - RNA, 20 nt, Artificial Sequence
  Synthetic
ucccaaagugcugggauuac

SEQ ID NO: 4981 - RNA, 20 nt, Artificial Sequence
  Synthetic
ucccaaagugcugggauuac

SEQ ID NO: 4982 - RNA, 20 nt, Artificial Sequence
  Synthetic
ucccaaagugcugggauuac

SEQ ID NO: 4983 - RNA, 20 nt, Artificial Sequence
  Synthetic
ucccaaagugcugggauuac

SEQ ID NO: 4984 - RNA, 20 nt, Artificial Sequence
  Synthetic
ucccaaagugcugggauuac

SEQ ID NO: 4985 - RNA, 20 nt, Artificial Sequence
  Synthetic
uguaaucccagcacuuuggg

SEQ ID NO: 4986 - RNA, 20 nt, Artificial Sequence
  Synthetic
uguaaucccagcacuuuggg

SEQ ID NO: 4987 - RNA, 20 nt, Artificial Sequence
  Synthetic
uguaaucccagcacuuuggg

SEQ ID NO: 4988 - RNA, 20 nt, Artificial Sequence
  Synthetic
uguaaucccagcacuuuggg

SEQ ID NO: 4989 - RNA, 20 nt, Artificial Sequence
  Synthetic
uguaaucccagcacuuuggg

SEQ ID NO: 4990 - RNA, 20 nt, Artificial Sequence
  Synthetic
accugaguaauaaaaauugu

SEQ ID NO: 4991 - RNA, 20 nt, Artificial Sequence
  Synthetic
uccaacaauuuuuauuacuc

SEQ ID NO: 4992 - RNA, 20 nt, Artificial Sequence
  Synthetic
caacaugccaauuaguucac

SEQ ID NO: 4993 - RNA, 20 nt, Artificial Sequence
  Synthetic
uuaauaaccugugaacuaau

SEQ ID NO: 4994 - RNA, 20 nt, Artificial Sequence
  Synthetic
ucacagguuauuaauuuaaa

SEQ ID NO: 4995 - RNA, 20 nt, Artificial Sequence
  Synthetic
uuuaaaaggucacuguugug

SEQ ID NO: 4996 - RNA, 20 nt, Artificial Sequence
  Synthetic
cuuugucacugucuugcucc

SEQ ID NO: 4997 - RNA, 20 nt, Artificial Sequence
  Synthetic
cugucuugcuccuggcuucc

SEQ ID NO: 4998 - RNA, 20 nt, Artificial Sequence
  Synthetic
ccuggcuuccugguuucaug

SEQ ID NO: 4999 - RNA, 20 nt, Artificial Sequence
  Synthetic
ccucaugaaaccaggaagcc

SEQ ID NO: 5000 - RNA, 20 nt, Artificial Sequence
  Synthetic
agaagguuccucaugaaacc

SEQ ID NO: 5001 - RNA, 20 nt, Artificial Sequence
  Synthetic
aauaucauuugaacuuuaga

SEQ ID NO: 5002 - RNA, 20 nt, Artificial Sequence
  Synthetic
auugaaacucaacagaaaga

SEQ ID NO: 5003 - RNA, 20 nt, Artificial Sequence
  Synthetic
aaacucaacagaaagaagga

SEQ ID NO: 5004 - RNA, 20 nt, Artificial Sequence
  Synthetic
aacucaacagaaagaaggaa

SEQ ID NO: 5005 - RNA, 20 nt, Artificial Sequence
  Synthetic
uuguuuuuauagaaacucug

SEQ ID NO: 5006 - RNA, 20 nt, Artificial Sequence
  Synthetic
uaaugagaagucauguuucu

SEQ ID NO: 5007 - RNA, 20 nt, Artificial Sequence
  Synthetic
ucauguuucuuggaaauuuu

SEQ ID NO: 5008 - RNA, 20 nt, Artificial Sequence
  Synthetic
uguuucuuggaaauuuuagg

SEQ ID NO: 5009 - RNA, 20 nt, Artificial Sequence
  Synthetic
uagaauuuaauauuguaagc

SEQ ID NO: 5010 - RNA, 20 nt, Artificial Sequence
  Synthetic
uguaagccggacuauuacug

SEQ ID NO: 5011 - RNA, 20 nt, Artificial Sequence
  Synthetic
guaagccggacuauuacuga

SEQ ID NO: 5012 - RNA, 20 nt, Artificial Sequence
  Synthetic
cuuaacccucaguaauaguc

SEQ ID NO: 5013 - RNA, 20 nt, Artificial Sequence
  Synthetic
cggacuauuacugaggguua

SEQ ID NO: 5014 - RNA, 20 nt, Artificial Sequence
  Synthetic
gaagcuauuaauagcucugc

SEQ ID NO: 5015 - RNA, 20 nt, Artificial Sequence
  Synthetic
aagcuauuaauagcucugcu

SEQ ID NO: 5016 - RNA, 20 nt, Artificial Sequence
  Synthetic
ugcugggacaaguguaaaug

SEQ ID NO: 5017 - RNA, 20 nt, Artificial Sequence
  Synthetic
guguaaaugaggacuguccc

SEQ ID NO: 5018 - RNA, 20 nt, Artificial Sequence
  Synthetic
aggacugucccaggcaaauc

SEQ ID NO: 5019 - RNA, 20 nt, Artificial Sequence
  Synthetic
ucccaggcaaaucaggacaa

SEQ ID NO: 5020 - RNA, 20 nt, Artificial Sequence
  Synthetic
cccaggcaaaucaggacaaa

SEQ ID NO: 5021 - RNA, 20 nt, Artificial Sequence
  Synthetic
cccuuuguccugauuugccu

SEQ ID NO: 5022 - RNA, 20 nt, Artificial Sequence
  Synthetic
acccuuuguccugauuugcc

SEQ ID NO: 5023 - RNA, 20 nt, Artificial Sequence
  Synthetic
gggucacccuaguuuaaaua

SEQ ID NO: 5024 - RNA, 20 nt, Artificial Sequence
  Synthetic
gcuaauccauauuuaaacua

SEQ ID NO: 5025 - RNA, 20 nt, Artificial Sequence
  Synthetic
ugcuaauccauauuuaaacu

SEQ ID NO: 5026 - RNA, 20 nt, Artificial Sequence
  Synthetic
uuuaaauauggauuagcaua

SEQ ID NO: 5027 - RNA, 20 nt, Artificial Sequence
  Synthetic
uauuagacugcaguggugcu

SEQ ID NO: 5028 - RNA, 20 nt, Artificial Sequence
  Synthetic
agacuucuauuagacugcag

SEQ ID NO: 5029 - RNA, 20 nt, Artificial Sequence
  Synthetic
uaggguuuauugacuuucuu

SEQ ID NO: 5030 - RNA, 20 nt, Artificial Sequence
  Synthetic
uggaauauauugagucuuua

SEQ ID NO: 5031 - RNA, 20 nt, Artificial Sequence
  Synthetic
auggaauauauugagucuuu

SEQ ID NO: 5032 - RNA, 20 nt, Artificial Sequence
  Synthetic
auuuagaaguuuaaaaguga

SEQ ID NO: 5033 - RNA, 20 nt, Artificial Sequence
  Synthetic
cacuuuuaaacuucuaaaug

SEQ ID NO: 5034 - RNA, 20 nt, Artificial Sequence
  Synthetic
uaaacuucuaaauguggccc

SEQ ID NO: 5035 - RNA, 20 nt, Artificial Sequence
  Synthetic
cuucuaaauguggcccuggc

SEQ ID NO: 5036 - RNA, 20 nt, Artificial Sequence
  Synthetic
uaagcauauuaugccugcca

SEQ ID NO: 5037 - RNA, 20 nt, Artificial Sequence
  Synthetic
uuaagcauauuaugccugcc

SEQ ID NO: 5038 - RNA, 20 nt, Artificial Sequence
  Synthetic
aggcauaauaugcuuaaaua

SEQ ID NO: 5039 - RNA, 20 nt, Artificial Sequence
  Synthetic
agagaguauuaugucuaaga

SEQ ID NO: 5040 - RNA, 20 nt, Artificial Sequence
  Synthetic
gggcacuagagagguaagag

SEQ ID NO: 5041 - RNA, 20 nt, Artificial Sequence
  Synthetic
ugaauugaugggcacuagag

SEQ ID NO: 5042 - RNA, 20 nt, Artificial Sequence
  Synthetic
aaaaggaauucugaauugau

SEQ ID NO: 5043 - RNA, 20 nt, Artificial Sequence
  Synthetic
uaaaaggaauucugaauuga

SEQ ID NO: 5044 - RNA, 20 nt, Artificial Sequence
  Synthetic
uugaaaguauaaacuuuaaa

SEQ ID NO: 5045 - RNA, 20 nt, Artificial Sequence
  Synthetic
uacuuucaaauauuaaaaau

SEQ ID NO: 5046 - RNA, 20 nt, Artificial Sequence
  Synthetic
aaauauuaaaaauugguuga

SEQ ID NO: 5047 - RNA, 20 nt, Artificial Sequence
  Synthetic
aauauuaaaaauugguugaa

SEQ ID NO: 5048 - RNA, 20 nt, Artificial Sequence
  Synthetic
uuaaaaauugguugaagggu

SEQ ID NO: 5049 - RNA, 20 nt, Artificial Sequence
  Synthetic
uaaaaauugguugaaggguu

SEQ ID NO: 5050 - RNA, 20 nt, Artificial Sequence
  Synthetic
aaaaauugguugaaggguug

SEQ ID NO: 5051 - RNA, 20 nt, Artificial Sequence
  Synthetic
ugguugaaggguuggggaug

SEQ ID NO: 5052 - RNA, 20 nt, Artificial Sequence
  Synthetic
ggguuggggauguggcucag

SEQ ID NO: 5053 - RNA, 20 nt, Artificial Sequence
  Synthetic
gacucaugaaggcugggcag

SEQ ID NO: 5054 - RNA, 20 nt, Artificial Sequence
  Synthetic
ggacucaugaaggcugggca

SEQ ID NO: 5055 - RNA, 20 nt, Artificial Sequence
  Synthetic
gggacucaugaaggcugggc

SEQ ID NO: 5056 - RNA, 20 nt, Artificial Sequence
  Synthetic
cucagggacucaugaaggcu

SEQ ID NO: 5057 - RNA, 20 nt, Artificial Sequence
  Synthetic
acucagggacucaugaaggc

SEQ ID NO: 5058 - RNA, 20 nt, Artificial Sequence
  Synthetic
uuuaacucagggacucauga

SEQ ID NO: 5059 - RNA, 20 nt, Artificial Sequence
  Synthetic
gcuucugggaauuuaacuca

SEQ ID NO: 5060 - RNA, 20 nt, Artificial Sequence
  Synthetic
ugcuucugggaauuuaacuc

SEQ ID NO: 5061 - RNA, 20 nt, Artificial Sequence
  Synthetic
guuugucuuauacugcuucu

SEQ ID NO: 5062 - RNA, 20 nt, Artificial Sequence
  Synthetic
uguuugucuuauacugcuuc

SEQ ID NO: 5063 - RNA, 20 nt, Artificial Sequence
  Synthetic
accuuacuucauccauuuuc

SEQ ID NO: 5064 - RNA, 20 nt, Artificial Sequence
  Synthetic
gccagaaaauggaugaagua

SEQ ID NO: 5065 - RNA, 20 nt, Artificial Sequence
  Synthetic
uguguagcuaugccagaaaa

SEQ ID NO: 5066 - RNA, 20 nt, Artificial Sequence
  Synthetic
cauaccugcaauccuaguuc

SEQ ID NO: 5067 - RNA, 20 nt, Artificial Sequence
  Synthetic
uuguccagaacuaggauugc

SEQ ID NO: 5068 - RNA, 20 nt, Artificial Sequence
  Synthetic
gcuugaauuuguccagaacu

SEQ ID NO: 5069 - RNA, 20 nt, Artificial Sequence
  Synthetic
aguucuggacaaauucaagc

SEQ ID NO: 5070 - RNA, 20 nt, Artificial Sequence
  Synthetic
aaugccaaccucagcuacuu

SEQ ID NO: 5071 - RNA, 20 nt, Artificial Sequence
  Synthetic
caaaccuaaguagcugaggu

SEQ ID NO: 5072 - RNA, 20 nt, Artificial Sequence
  Synthetic
caaccucagcuacuuagguu

SEQ ID NO: 5073 - RNA, 20 nt, Artificial Sequence
  Synthetic
aaccucagcuacuuagguuu

SEQ ID NO: 5074 - RNA, 20 nt, Artificial Sequence
  Synthetic
agcccaaaccuaaguagcug

SEQ ID NO: 5075 - RNA, 20 nt, Artificial Sequence
  Synthetic
cugagacccugucuuaacau

SEQ ID NO: 5076 - RNA, 20 nt, Artificial Sequence
  Synthetic
ugagacccugucuuaacauu

SEQ ID NO: 5077 - RNA, 20 nt, Artificial Sequence
  Synthetic
gagacccugucuuaacauug

SEQ ID NO: 5078 - RNA, 20 nt, Artificial Sequence
  Synthetic
agacccugucuuaacauugg

SEQ ID NO: 5079 - RNA, 20 nt, Artificial Sequence
  Synthetic
ucucccccaauguuaagaca

SEQ ID NO: 5080 - RNA, 20 nt, Artificial Sequence
  Synthetic
cucucccccaauguuaagac

SEQ ID NO: 5081 - RNA, 20 nt, Artificial Sequence
  Synthetic
uuaacauugggggagagccu

SEQ ID NO: 5082 - RNA, 20 nt, Artificial Sequence
  Synthetic
auugggggagagccuaggcu

SEQ ID NO: 5083 - RNA, 20 nt, Artificial Sequence
  Synthetic
uguauagcucagccuagccu

SEQ ID NO: 5084 - RNA, 20 nt, Artificial Sequence
  Synthetic
cuauacaguaagccucuguc

SEQ ID NO: 5085 - RNA, 20 nt, Artificial Sequence
  Synthetic
uauacaguaagccucugucu

SEQ ID NO: 5086 - RNA, 20 nt, Artificial Sequence
  Synthetic
caguaagccucugucuggga

SEQ ID NO: 5087 - RNA, 20 nt, Artificial Sequence
  Synthetic
uaagccucugucugggaagg

SEQ ID NO: 5088 - RNA, 20 nt, Artificial Sequence
  Synthetic
aagccucugucugggaagga

SEQ ID NO: 5089 - RNA, 20 nt, Artificial Sequence
  Synthetic
uuucccuccuucccagacag

SEQ ID NO: 5090 - RNA, 20 nt, Artificial Sequence
  Synthetic
ugucugggaaggagggaaaa

SEQ ID NO: 5091 - RNA, 20 nt, Artificial Sequence
  Synthetic
ugggaaggagggaaaaagga

SEQ ID NO: 5092 - RNA, 20 nt, Artificial Sequence
  Synthetic
gaaaaaggaaggaaagacau

SEQ ID NO: 5093 - RNA, 20 nt, Artificial Sequence
  Synthetic
gacauugguugaaugacuug

SEQ ID NO: 5094 - RNA, 20 nt, Artificial Sequence
  Synthetic
acauugguugaaugacuugu

SEQ ID NO: 5095 - RNA, 20 nt, Artificial Sequence
  Synthetic
acuguauguuuagaguguuc

SEQ ID NO: 5096 - RNA, 20 nt, Artificial Sequence
  Synthetic
cuguauguuuagaguguuca

SEQ ID NO: 5097 - RNA, 20 nt, Artificial Sequence
  Synthetic
guuuagaguguucagggaaa

SEQ ID NO: 5098 - RNA, 20 nt, Artificial Sequence
  Synthetic
uagaguguucagggaaaagg

SEQ ID NO: 5099 - RNA, 20 nt, Artificial Sequence
  Synthetic
aggucauuugcagagcagag

SEQ ID NO: 5100 - RNA, 20 nt, Artificial Sequence
  Synthetic
auucgucuuaucugaguggc

SEQ ID NO: 5101 - RNA, 20 nt, Artificial Sequence
  Synthetic
guguauucgucuuaucugag

SEQ ID NO: 5102 - RNA, 20 nt, Artificial Sequence
  Synthetic
caugaauauagaagaaacag

SEQ ID NO: 5103 - RNA, 20 nt, Artificial Sequence
  Synthetic
aauaaaagacacaagacugc

SEQ ID NO: 5104 - RNA, 20 nt, Artificial Sequence
  Synthetic
cuaauaauauuucuaguguc

SEQ ID NO: 5105 - RNA, 20 nt, Artificial Sequence
  Synthetic
cuugagauuuuauuuucaca

SEQ ID NO: 5106 - RNA, 20 nt, Artificial Sequence
  Synthetic
cuugugaaaauaaaaucuca

SEQ ID NO: 5107 - RNA, 20 nt, Artificial Sequence
  Synthetic
aauaaaaucucaaggucaua

SEQ ID NO: 5108 - RNA, 20 nt, Artificial Sequence
  Synthetic
uacggcaaacacaaagaaac

SEQ ID NO: 5109 - RNA, 20 nt, Artificial Sequence
  Synthetic
gucuucagacacuccagaag

SEQ ID NO: 5110 - RNA, 20 nt, Artificial Sequence
  Synthetic
ucuucagacacuccagaaga

SEQ ID NO: 5111 - RNA, 20 nt, Artificial Sequence
  Synthetic
cgagaucugaugcccucuuc

SEQ ID NO: 5112 - RNA, 20 nt, Artificial Sequence
  Synthetic
gagggcaucagaucucguua

SEQ ID NO: 5113 - RNA, 20 nt, Artificial Sequence
  Synthetic
gcaucagaucucguuacgga

SEQ ID NO: 5114 - RNA, 20 nt, Artificial Sequence
  Synthetic
gaugguugugagccaccaug

SEQ ID NO: 5115 - RNA, 20 nt, Artificial Sequence
  Synthetic
gugagccaccaugugguugc

SEQ ID NO: 5116 - RNA, 20 nt, Artificial Sequence
  Synthetic
ugagccaccaugugguugcu

SEQ ID NO: 5117 - RNA, 20 nt, Artificial Sequence
  Synthetic
aaaucccagcaaccacaugg

SEQ ID NO: 5118 - RNA, 20 nt, Artificial Sequence
  Synthetic
uucaaaucccagcaaccaca

SEQ ID NO: 5119 - RNA, 20 nt, Artificial Sequence
  Synthetic
ggauuugaacuucagaccuu

SEQ ID NO: 5120 - RNA, 20 nt, Artificial Sequence
  Synthetic
cagaccuucggaagagcagu

SEQ ID NO: 5121 - RNA, 20 nt, Artificial Sequence
  Synthetic
agaccuucggaagagcaguc

SEQ ID NO: 5122 - RNA, 20 nt, Artificial Sequence
  Synthetic
gcacccgacugcucuuccga

SEQ ID NO: 5123 - RNA, 20 nt, Artificial Sequence
  Synthetic
ggcuggugagauggcucagu

SEQ ID NO: 5124 - RNA, 20 nt, Artificial Sequence
  Synthetic
gggcuggugagauggcucag

SEQ ID NO: 5125 - RNA, 20 nt, Artificial Sequence
  Synthetic
ugagccaucucaccagcccc

SEQ ID NO: 5126 - RNA, 20 nt, Artificial Sequence
  Synthetic
aaaaccuggggcuggugaga

SEQ ID NO: 5127 - RNA, 20 nt, Artificial Sequence
  Synthetic
agaaaaaaaaaaccuggggc

SEQ ID NO: 5128 - RNA, 20 nt, Artificial Sequence
  Synthetic
acuaagaaaaaaaaaaccug

SEQ ID NO: 5129 - RNA, 20 nt, Artificial Sequence
  Synthetic
aacuaagaaaaaaaaaaccu

SEQ ID NO: 5130 - RNA, 20 nt, Artificial Sequence
  Synthetic
caacuaagaaaaaaaaaacc

SEQ ID NO: 5131 - RNA, 20 nt, Artificial Sequence
  Synthetic
uauuguuauucuuuugagac

SEQ ID NO: 5132 - RNA, 20 nt, Artificial Sequence
  Synthetic
aggaucccacacugaaacuc

SEQ ID NO: 5133 - RNA, 20 nt, Artificial Sequence
  Synthetic
gcuagccugaguuucagugu

SEQ ID NO: 5134 - RNA, 20 nt, Artificial Sequence
  Synthetic
ggcuagccugaguuucagug

SEQ ID NO: 5135 - RNA, 20 nt, Artificial Sequence
  Synthetic
ggcuagccuucaauuuccua

SEQ ID NO: 5136 - RNA, 20 nt, Artificial Sequence
  Synthetic
ucaaauccauaggaaauuga

SEQ ID NO: 5137 - RNA, 20 nt, Artificial Sequence
  Synthetic
ugcuaugaggucaaauccau

SEQ ID NO: 5138 - RNA, 20 nt, Artificial Sequence
  Synthetic
gaaacuggcugacugcuaug

SEQ ID NO: 5139 - RNA, 20 nt, Artificial Sequence
  Synthetic
agcacucagaagguggaaac

SEQ ID NO: 5140 - RNA, 20 nt, Artificial Sequence
  Synthetic
aaaucuuagcacucagaagg

SEQ ID NO: 5141 - RNA, 20 nt, Artificial Sequence
  Synthetic
uugaaaucuuagcacucaga

SEQ ID NO: 5142 - RNA, 20 nt, Artificial Sequence
  Synthetic
ggaauugggugugguggcuc

SEQ ID NO: 5143 - RNA, 20 nt, Artificial Sequence
  Synthetic
aucuuaggaauugggugugg

SEQ ID NO: 5144 - RNA, 20 nt, Artificial Sequence
  Synthetic
cauaucuuaggaauugggug

SEQ ID NO: 5145 - RNA, 20 nt, Artificial Sequence
  Synthetic
aaaaacauaucuuaggaauu

SEQ ID NO: 5146 - RNA, 20 nt, Artificial Sequence
  Synthetic
uaaaaacauaucuuaggaau

SEQ ID NO: 5147 - RNA, 20 nt, Artificial Sequence
  Synthetic
cuugcuuaaaaacauaucuu

SEQ ID NO: 5148 - RNA, 20 nt, Artificial Sequence
  Synthetic
cuaagauauguuuuuaagca

SEQ ID NO: 5149 - RNA, 20 nt, Artificial Sequence
  Synthetic
auguuuuuaagcaagguuau

SEQ ID NO: 5150 - RNA, 20 nt, Artificial Sequence
  Synthetic
cacgucauugcaaaggguua

SEQ ID NO: 5151 - RNA, 20 nt, Artificial Sequence
  Synthetic
acccuuugcaaugacguguc

SEQ ID NO: 5152 - RNA, 20 nt, Artificial Sequence
  Synthetic
uccugacacgucauugcaaa

SEQ ID NO: 5153 - RNA, 20 nt, Artificial Sequence
  Synthetic
uuccugacacgucauugcaa

SEQ ID NO: 5154 - RNA, 20 nt, Artificial Sequence
  Synthetic
gacaacuggaaaaaaaaaaa

SEQ ID NO: 5155 - RNA, 20 nt, Artificial Sequence
  Synthetic
uuuuuuuuuuuccaguuguc

SEQ ID NO: 5156 - RNA, 20 nt, Artificial Sequence
  Synthetic
uuuuuuccaguugucaggcc

SEQ ID NO: 5157 - RNA, 20 nt, Artificial Sequence
  Synthetic
ccaguugucaggccuggcaa

SEQ ID NO: 5158 - RNA, 20 nt, Artificial Sequence
  Synthetic
ccauugccaggccugacaac

SEQ ID NO: 5159 - RNA, 20 nt, Artificial Sequence
  Synthetic
caggccuggcaauggagccc

SEQ ID NO: 5160 - RNA, 20 nt, Artificial Sequence
  Synthetic
aggccuggcaauggagccca

SEQ ID NO: 5161 - RNA, 20 nt, Artificial Sequence
  Synthetic
gggcccugggcuccauugcc

SEQ ID NO: 5162 - RNA, 20 nt, Artificial Sequence
  Synthetic
uuuagcaagcacagggcccu

SEQ ID NO: 5163 - RNA, 20 nt, Artificial Sequence
  Synthetic
guuuagcaagcacagggccc

SEQ ID NO: 5164 - RNA, 20 nt, Artificial Sequence
  Synthetic
gcccugugcuugcuaaacga

SEQ ID NO: 5165 - RNA, 20 nt, Artificial Sequence
  Synthetic
gccaucguuuagcaagcaca

SEQ ID NO: 5166 - RNA, 20 nt, Artificial Sequence
  Synthetic
agccaucguuuagcaagcac

SEQ ID NO: 5167 - RNA, 20 nt, Artificial Sequence
  Synthetic
gcuggguauauauaacuuag

SEQ ID NO: 5168 - RNA, 20 nt, Artificial Sequence
  Synthetic
agcuggguauauauaacuua

SEQ ID NO: 5169 - RNA, 20 nt, Artificial Sequence
  Synthetic
aagcuggguauauauaacuu

SEQ ID NO: 5170 - RNA, 20 nt, Artificial Sequence
  Synthetic
auauauacccagcuuauccc

SEQ ID NO: 5171 - RNA, 20 nt, Artificial Sequence
  Synthetic
gaaagauccugggauaagcu

SEQ ID NO: 5172 - RNA, 20 nt, Artificial Sequence
  Synthetic
agaaagauccugggauaagc

SEQ ID NO: 5173 - RNA, 20 nt, Artificial Sequence
  Synthetic
gaaagucugagaaagauccu

SEQ ID NO: 5174 - RNA, 20 nt, Artificial Sequence
  Synthetic
agaaagucugagaaagaucc

SEQ ID NO: 5175 - RNA, 20 nt, Artificial Sequence
  Synthetic
cuaucgauguugcuucucuu

SEQ ID NO: 5176 - RNA, 20 nt, Artificial Sequence
  Synthetic
cuuuuugugagaaaagagca

SEQ ID NO: 5177 - RNA, 20 nt, Artificial Sequence
  Synthetic
ucuaagcaagaacccuuguc

SEQ ID NO: 5178 - RNA, 20 nt, Artificial Sequence
  Synthetic
aucucucugacuccagacaa

SEQ ID NO: 5179 - RNA, 20 nt, Artificial Sequence
  Synthetic
uaucucucugacuccagaca

SEQ ID NO: 5180 - RNA, 20 nt, Artificial Sequence
  Synthetic
gucagagagauagcuuaguc

SEQ ID NO: 5181 - RNA, 20 nt, Artificial Sequence
  Synthetic
uuuaaacaagaaaaguucug

SEQ ID NO: 5182 - RNA, 20 nt, Artificial Sequence
  Synthetic
uuuuaaacaagaaaaguucu

SEQ ID NO: 5183 - RNA, 20 nt, Artificial Sequence
  Synthetic
uuuuuaaacaagaaaaguuc

SEQ ID NO: 5184 - RNA, 20 nt, Artificial Sequence
  Synthetic
caaacaaacaaacaaaaacu

SEQ ID NO: 5185 - RNA, 20 nt, Artificial Sequence
  Synthetic
caaaaacuaggcaugacagc

SEQ ID NO: 5186 - RNA, 20 nt, Artificial Sequence
  Synthetic
acuaggcaugacagcuggag

SEQ ID NO: 5187 - RNA, 20 nt, Artificial Sequence
  Synthetic
aggcaugacagcuggagagg

SEQ ID NO: 5188 - RNA, 20 nt, Artificial Sequence
  Synthetic
auuaacagcacuuguuaaag

SEQ ID NO: 5189 - RNA, 20 nt, Artificial Sequence
  Synthetic
uguuaaagaggaccucagcu

SEQ ID NO: 5190 - RNA, 20 nt, Artificial Sequence
  Synthetic
aggaccucagcuugguuccc

SEQ ID NO: 5191 - RNA, 20 nt, Artificial Sequence
  Synthetic
ggaccucagcuugguuccca

SEQ ID NO: 5192 - RNA, 20 nt, Artificial Sequence
  Synthetic
gagcccugggaaccaagcug

SEQ ID NO: 5193 - RNA, 20 nt, Artificial Sequence
  Synthetic
aacuggaguuauagagcccu

SEQ ID NO: 5194 - RNA, 20 nt, Artificial Sequence
  Synthetic
gaacuggaguuauagagccc

SEQ ID NO: 5195 - RNA, 20 nt, Artificial Sequence
  Synthetic
ggcucuauaacuccaguucc

SEQ ID NO: 5196 - RNA, 20 nt, Artificial Sequence
  Synthetic
gcucuauaacuccaguucca

SEQ ID NO: 5197 - RNA, 20 nt, Artificial Sequence
  Synthetic
gcugucugaggcccuggaac

SEQ ID NO: 5198 - RNA, 20 nt, Artificial Sequence
  Synthetic
caggaggcugucugaggccc

SEQ ID NO: 5199 - RNA, 20 nt, Artificial Sequence
  Synthetic
aggcuacaggaggcugucug

SEQ ID NO: 5200 - RNA, 20 nt, Artificial Sequence
  Synthetic
augcaugaagaggcuacagg

SEQ ID NO: 5201 - RNA, 20 nt, Artificial Sequence
  Synthetic
cugaugcaugaagaggcuac

SEQ ID NO: 5202 - RNA, 20 nt, Artificial Sequence
  Synthetic
gccucuucaugcaucagaca

SEQ ID NO: 5203 - RNA, 20 nt, Artificial Sequence
  Synthetic
accaugucugaugcaugaag

SEQ ID NO: 5204 - RNA, 20 nt, Artificial Sequence
  Synthetic
gacaugguccauaugcaugc

SEQ ID NO: 5205 - RNA, 20 nt, Artificial Sequence
  Synthetic
guguuugaccugcaugcaua

SEQ ID NO: 5206 - RNA, 20 nt, Artificial Sequence
  Synthetic
aaaaauaaaagucuaaaaaa

SEQ ID NO: 5207 - RNA, 20 nt, Artificial Sequence
  Synthetic
caugcuauaaucccagugcu

SEQ ID NO: 5208 - RNA, 20 nt, Artificial Sequence
  Synthetic
augcuauaaucccagugcua

SEQ ID NO: 5209 - RNA, 20 nt, Artificial Sequence
  Synthetic
cuauaaucccagugcuaggg

SEQ ID NO: 5210 - RNA, 20 nt, Artificial Sequence
  Synthetic
acauuugccucccuagcacu

SEQ ID NO: 5211 - RNA, 20 nt, Artificial Sequence
  Synthetic
gacauuugccucccuagcac

SEQ ID NO: 5212 - RNA, 20 nt, Artificial Sequence
  Synthetic
gugcuagggaggcaaauguc

SEQ ID NO: 5213 - RNA, 20 nt, Artificial Sequence
  Synthetic
ggcaaaugucuggaccuugu

SEQ ID NO: 5214 - RNA, 20 nt, Artificial Sequence
  Synthetic
aaugucuggaccuugucggu

SEQ ID NO: 5215 - RNA, 20 nt, Artificial Sequence
  Synthetic
gacugacuggccgaccgaca

SEQ ID NO: 5216 - RNA, 20 nt, Artificial Sequence
  Synthetic
ugacuggcuggcugacugac

SEQ ID NO: 5217 - RNA, 20 nt, Artificial Sequence
  Synthetic
gcuaggcuagacugacuggc

SEQ ID NO: 5218 - RNA, 20 nt, Artificial Sequence
  Synthetic
cuaugcuaggcuagacugac

SEQ ID NO: 5219 - RNA, 20 nt, Artificial Sequence
  Synthetic
cuagccuagcauagccuacu

SEQ ID NO: 5220 - RNA, 20 nt, Artificial Sequence
  Synthetic
cacaccuaguaggcuaugcu

SEQ ID NO: 5221 - RNA, 20 nt, Artificial Sequence
  Synthetic
ugggcuggagcacaccuagu

SEQ ID NO: 5222 - RNA, 20 nt, Artificial Sequence
  Synthetic
gacaaggucucucauugggc

SEQ ID NO: 5223 - RNA, 20 nt, Artificial Sequence
  Synthetic
uagagacaaggucucucauu

SEQ ID NO: 5224 - RNA, 20 nt, Artificial Sequence
  Synthetic
uuagagacaaggucucucau

SEQ ID NO: 5225 - RNA, 20 nt, Artificial Sequence
  Synthetic
agaccuugucucuaaaaaaa

SEQ ID NO: 5226 - RNA, 20 nt, Artificial Sequence
  Synthetic
gaccuugucucuaaaaaaaa

SEQ ID NO: 5227 - RNA, 20 nt, Artificial Sequence
  Synthetic
uacccuuuuuuuuagagaca

SEQ ID NO: 5228 - RNA, 20 nt, Artificial Sequence
  Synthetic
gguagaaagaaaagacaaaa

SEQ ID NO: 5229 - RNA, 20 nt, Artificial Sequence
  Synthetic
gacaaaauggaugucuccug

SEQ ID NO: 5230 - RNA, 20 nt, Artificial Sequence
  Synthetic
cuccugaggaaugauaccca

SEQ ID NO: 5231 - RNA, 20 nt, Artificial Sequence
  Synthetic
auccguggguaucauuccuc

SEQ ID NO: 5232 - RNA, 20 nt, Artificial Sequence
  Synthetic
ggacaauuguggguauccgu

SEQ ID NO: 5233 - RNA, 20 nt, Artificial Sequence
  Synthetic
aggacaauuguggguauccg

SEQ ID NO: 5234 - RNA, 20 nt, Artificial Sequence
  Synthetic
ggauacccacaauuguccuc

SEQ ID NO: 5235 - RNA, 20 nt, Artificial Sequence
  Synthetic
ggagaccagaggacaauugu

SEQ ID NO: 5236 - RNA, 20 nt, Artificial Sequence
  Synthetic
cggagaccagaggacaauug

SEQ ID NO: 5237 - RNA, 20 nt, Artificial Sequence
  Synthetic
guauugcacacggagaccag

SEQ ID NO: 5238 - RNA, 20 nt, Artificial Sequence
  Synthetic
acauggguuuguauugcaca

SEQ ID NO: 5239 - RNA, 20 nt, Artificial Sequence
  Synthetic
uguugcaaauauucagacau

SEQ ID NO: 5240 - RNA, 20 nt, Artificial Sequence
  Synthetic
cuguugcaaauauucagaca

SEQ ID NO: 5241 - RNA, 20 nt, Artificial Sequence
  Synthetic
caugucugaauauuugcaac

SEQ ID NO: 5242 - RNA, 20 nt, Artificial Sequence
  Synthetic
augucugaauauuugcaaca

SEQ ID NO: 5243 - RNA, 20 nt, Artificial Sequence
  Synthetic
agcacagcuuuacuagauga

SEQ ID NO: 5244 - RNA, 20 nt, Artificial Sequence
  Synthetic
aagcacagcuuuacuagaug

SEQ ID NO: 5245 - RNA, 20 nt, Artificial Sequence
  Synthetic
caucuaguaaagcugugcuu

SEQ ID NO: 5246 - RNA, 20 nt, Artificial Sequence
  Synthetic
gaaaaauaagacagauggga

SEQ ID NO: 5247 - RNA, 20 nt, Artificial Sequence
  Synthetic
agaaaaauaagacagauggg

SEQ ID NO: 5248 - RNA, 20 nt, Artificial Sequence
  Synthetic
aguagaaaaauaagacagau

SEQ ID NO: 5249 - RNA, 20 nt, Artificial Sequence
  Synthetic
caguagaaaaauaagacaga

SEQ ID NO: 5250 - RNA, 20 nt, Artificial Sequence
  Synthetic
caucugucuuauuuuucuac

SEQ ID NO: 5251 - RNA, 20 nt, Artificial Sequence
  Synthetic
auuuuucuacuggugugcua

SEQ ID NO: 5252 - RNA, 20 nt, Artificial Sequence
  Synthetic
gugcuaaggcaccaugacca

SEQ ID NO: 5253 - RNA, 20 nt, Artificial Sequence
  Synthetic
ucucuaaguugccuugguca

SEQ ID NO: 5254 - RNA, 20 nt, Artificial Sequence
  Synthetic
ucuucuucucuaaguugccu

SEQ ID NO: 5255 - RNA, 20 nt, Artificial Sequence
  Synthetic
gaagaagaaacaguuuauug

SEQ ID NO: 5256 - RNA, 20 nt, Artificial Sequence
  Synthetic
aagaagaaacaguuuauuga

SEQ ID NO: 5257 - RNA, 20 nt, Artificial Sequence
  Synthetic
uugaggguuuauaguuauag

SEQ ID NO: 5258 - RNA, 20 nt, Artificial Sequence
  Synthetic
ugaggguuuauaguuauaga

SEQ ID NO: 5259 - RNA, 20 nt, Artificial Sequence
  Synthetic
guuuauaguuauagagggua

SEQ ID NO: 5260 - RNA, 20 nt, Artificial Sequence
  Synthetic
uaguuauagaggguaaggca

SEQ ID NO: 5261 - RNA, 20 nt, Artificial Sequence
  Synthetic
uagaggguaaggcaaggacu

SEQ ID NO: 5262 - RNA, 20 nt, Artificial Sequence
  Synthetic
uaaggcaaggacuugguagc

SEQ ID NO: 5263 - RNA, 20 nt, Artificial Sequence
  Synthetic
gcaaggacuugguagcaggc

SEQ ID NO: 5264 - RNA, 20 nt, Artificial Sequence
  Synthetic
ggacuugguagcaggcaggc

SEQ ID NO: 5265 - RNA, 20 nt, Artificial Sequence
  Synthetic
uugguagcaggcaggcaggc

SEQ ID NO: 5266 - RNA, 20 nt, Artificial Sequence
  Synthetic
agcaggcaggcaggcaggca

SEQ ID NO: 5267 - RNA, 20 nt, Artificial Sequence
  Synthetic
caggcaggcaggcaugguac

SEQ ID NO: 5268 - RNA, 20 nt, Artificial Sequence
  Synthetic
caugguacugguguaguagc

SEQ ID NO: 5269 - RNA, 20 nt, Artificial Sequence
  Synthetic
augguacugguguaguagcu

SEQ ID NO: 5270 - RNA, 20 nt, Artificial Sequence
  Synthetic
ggagcuuguaucuugagaca

SEQ ID NO: 5271 - RNA, 20 nt, Artificial Sequence
  Synthetic
aaagcugagagauagcuaag

SEQ ID NO: 5272 - RNA, 20 nt, Artificial Sequence
  Synthetic
aagcugagagauagcuaagu

SEQ ID NO: 5273 - RNA, 20 nt, Artificial Sequence
  Synthetic
gagagauagcuaagugggcc

SEQ ID NO: 5274 - RNA, 20 nt, Artificial Sequence
  Synthetic
agguuucaaaagcucacacc

SEQ ID NO: 5275 - RNA, 20 nt, Artificial Sequence
  Synthetic
uuucacuggggacagcuuug

SEQ ID NO: 5276 - RNA, 20 nt, Artificial Sequence
  Synthetic
uugauggaggcauuucacug

SEQ ID NO: 5277 - RNA, 20 nt, Artificial Sequence
  Synthetic
guugauggaggcauuucacu

SEQ ID NO: 5278 - RNA, 20 nt, Artificial Sequence
  Synthetic
uguugauggaggcauuucac

SEQ ID NO: 5279 - RNA, 20 nt, Artificial Sequence
  Synthetic
gugaaaugccuccaucaaca

SEQ ID NO: 5280 - RNA, 20 nt, Artificial Sequence
  Synthetic
agguguggccuuguugaugg

SEQ ID NO: 5281 - RNA, 20 nt, Artificial Sequence
  Synthetic
guuagguguggccuuguuga

SEQ ID NO: 5282 - RNA, 20 nt, Artificial Sequence
  Synthetic
uguuugggaaggguuaggug

SEQ ID NO: 5283 - RNA, 20 nt, Artificial Sequence
  Synthetic
agaacuguuugggaaggguu

SEQ ID NO: 5284 - RNA, 20 nt, Artificial Sequence
  Synthetic
uugguagaacuguuugggaa

SEQ ID NO: 5285 - RNA, 20 nt, Artificial Sequence
  Synthetic
guugguagaacuguuuggga

SEQ ID NO: 5286 - RNA, 20 nt, Artificial Sequence
  Synthetic
ucccaaacaguucuaccaac

SEQ ID NO: 5287 - RNA, 20 nt, Artificial Sequence
  Synthetic
cccaaacaguucuaccaacu

SEQ ID NO: 5288 - RNA, 20 nt, Artificial Sequence
  Synthetic
cccaguugguagaacuguuu

SEQ ID NO: 5289 - RNA, 20 nt, Artificial Sequence
  Synthetic
ucccaguugguagaacuguu

SEQ ID NO: 5290 - RNA, 20 nt, Artificial Sequence
  Synthetic
augaaugcuugguucccagu

SEQ ID NO: 5291 - RNA, 20 nt, Artificial Sequence
  Synthetic
cugaggcucauaugaaugcu

SEQ ID NO: 5292 - RNA, 20 nt, Artificial Sequence
  Synthetic
caagcauucauaugagccuc

SEQ ID NO: 5293 - RNA, 20 nt, Artificial Sequence
  Synthetic
aagcauucauaugagccuca

SEQ ID NO: 5294 - RNA, 20 nt, Artificial Sequence
  Synthetic
agcauucauaugagccucag

SEQ ID NO: 5295 - RNA, 20 nt, Artificial Sequence
  Synthetic
ugaaugagacugcuccccug

SEQ ID NO: 5296 - RNA, 20 nt, Artificial Sequence
  Synthetic
guacucaguacacugcccca

SEQ ID NO: 5297 - RNA, 20 nt, Artificial Sequence
  Synthetic
uacucaguacacugccccau

SEQ ID NO: 5298 - RNA, 20 nt, Artificial Sequence
  Synthetic
uuagaggacuucugcccaug

SEQ ID NO: 5299 - RNA, 20 nt, Artificial Sequence
  Synthetic
uuuagaggacuucugcccau

SEQ ID NO: 5300 - RNA, 20 nt, Artificial Sequence
  Synthetic
guuuagaggacuucugccca

SEQ ID NO: 5301 - RNA, 20 nt, Artificial Sequence
  Synthetic
augggcagaaguccucuaaa

SEQ ID NO: 5302 - RNA, 20 nt, Artificial Sequence
  Synthetic
acacauuaguaaccguuuag

SEQ ID NO: 5303 - RNA, 20 nt, Artificial Sequence
  Synthetic
uaucccucaccauacuuaga

SEQ ID NO: 5304 - RNA, 20 nt, Artificial Sequence
  Synthetic
uuuccuucuaaguaugguga

SEQ ID NO: 5305 - RNA, 20 nt, Artificial Sequence
  Synthetic
guuuccuucuaaguauggug

SEQ ID NO: 5306 - RNA, 20 nt, Artificial Sequence
  Synthetic
ggcuuguuuccuucuaagua

SEQ ID NO: 5307 - RNA, 20 nt, Artificial Sequence
  Synthetic
ggaaacaagccaucccaaaa

SEQ ID NO: 5308 - RNA, 20 nt, Artificial Sequence
  Synthetic
ucaugcuauccauuuuggga

SEQ ID NO: 5309 - RNA, 20 nt, Artificial Sequence
  Synthetic
ugagucaugcuauccauuuu

SEQ ID NO: 5310 - RNA, 20 nt, Artificial Sequence
  Synthetic
cugagucaugcuauccauuu

SEQ ID NO: 5311 - RNA, 20 nt, Artificial Sequence
  Synthetic
uugcucugggugaaguacac

SEQ ID NO: 5312 - RNA, 20 nt, Artificial Sequence
  Synthetic
uacuucacccagagcaaaug

SEQ ID NO: 5313 - RNA, 20 nt, Artificial Sequence
  Synthetic
acccagagcaaauguggaua

SEQ ID NO: 5314 - RNA, 20 nt, Artificial Sequence
  Synthetic
accguauccacauuugcucu

SEQ ID NO: 5315 - RNA, 20 nt, Artificial Sequence
  Synthetic
caccguauccacauuugcuc

SEQ ID NO: 5316 - RNA, 20 nt, Artificial Sequence
  Synthetic
cagagcaaauguggauacgg

SEQ ID NO: 5317 - RNA, 20 nt, Artificial Sequence
  Synthetic
agagcaaauguggauacggu

SEQ ID NO: 5318 - RNA, 20 nt, Artificial Sequence
  Synthetic
guggauacggugggaaacag

SEQ ID NO: 5319 - RNA, 20 nt, Artificial Sequence
  Synthetic
gggaaacagaggacagugau

SEQ ID NO: 5320 - RNA, 20 nt, Artificial Sequence
  Synthetic
aggacagugauaggacacaa

SEQ ID NO: 5321 - RNA, 20 nt, Artificial Sequence
  Synthetic
gucucaguuucuaguucaga

SEQ ID NO: 5322 - RNA, 20 nt, Artificial Sequence
  Synthetic
agacauaaaccaacacacau

SEQ ID NO: 5323 - RNA, 20 nt, Artificial Sequence
  Synthetic
uguaucuuuccuaugugugu

SEQ ID NO: 5324 - RNA, 20 nt, Artificial Sequence
  Synthetic
auaggaaagauacacuccac

SEQ ID NO: 5325 - RNA, 20 nt, Artificial Sequence
  Synthetic
agauacacuccacuggacag

SEQ ID NO: 5326 - RNA, 20 nt, Artificial Sequence
  Synthetic
gauacacuccacuggacagu

SEQ ID NO: 5327 - RNA, 20 nt, Artificial Sequence
  Synthetic
caugggcucccacuguccag

SEQ ID NO: 5328 - RNA, 20 nt, Artificial Sequence
  Synthetic
cagugggagcccaugcacaa

SEQ ID NO: 5329 - RNA, 20 nt, Artificial Sequence
  Synthetic
gcccaugcacaaagguucuu

SEQ ID NO: 5330 - RNA, 20 nt, Artificial Sequence
  Synthetic
gccaaagaaccuuugugcau

SEQ ID NO: 5331 - RNA, 20 nt, Artificial Sequence
  Synthetic
agccaaagaaccuuugugca

SEQ ID NO: 5332 - RNA, 20 nt, Artificial Sequence
  Synthetic
ugacagcaguuucuuauuau

SEQ ID NO: 5333 - RNA, 20 nt, Artificial Sequence
  Synthetic
gacagcaguuucuuauuauu

SEQ ID NO: 5334 - RNA, 20 nt, Artificial Sequence
  Synthetic
gaugagcuuuguuucugccc

SEQ ID NO: 5335 - RNA, 20 nt, Artificial Sequence
  Synthetic
augagcuuuguuucugcccu

SEQ ID NO: 5336 - RNA, 20 nt, Artificial Sequence
  Synthetic
cccugggugagaguuuauuu

SEQ ID NO: 5337 - RNA, 20 nt, Artificial Sequence
  Synthetic
ccuaaauaaacucucaccca

SEQ ID NO: 5338 - RNA, 20 nt, Artificial Sequence
  Synthetic
uccuaaauaaacucucaccc

SEQ ID NO: 5339 - RNA, 20 nt, Artificial Sequence
  Synthetic
cacacuaagacaaccacuga

SEQ ID NO: 5340 - RNA, 20 nt, Artificial Sequence
  Synthetic
acuuuguucuaggccaucag

SEQ ID NO: 5341 - RNA, 20 nt, Artificial Sequence
  Synthetic
cagugcucugacuuuguucu

SEQ ID NO: 5342 - RNA, 20 nt, Artificial Sequence
  Synthetic
agucagagcacugugcguug

SEQ ID NO: 5343 - RNA, 20 nt, Artificial Sequence
  Synthetic
cacugugcguuguggaucuu

SEQ ID NO: 5344 - RNA, 20 nt, Artificial Sequence
  Synthetic
gaugcuuuaaucaucaugaa

SEQ ID NO: 5345 - RNA, 20 nt, Artificial Sequence
  Synthetic
acuaacacauuuuaauagga

SEQ ID NO: 5346 - RNA, 20 nt, Artificial Sequence
  Synthetic
auggacuaacacauuuuaau

SEQ ID NO: 5347 - RNA, 20 nt, Artificial Sequence
  Synthetic
aaaauguguuaguccauuuu

SEQ ID NO: 5348 - RNA, 20 nt, Artificial Sequence
  Synthetic
aaauguguuaguccauuuuu

SEQ ID NO: 5349 - RNA, 20 nt, Artificial Sequence
  Synthetic
aauguguuaguccauuuuug

SEQ ID NO: 5350 - RNA, 20 nt, Artificial Sequence
  Synthetic
aguaaacauaaccccaaaaa

SEQ ID NO: 5351 - RNA, 20 nt, Artificial Sequence
  Synthetic
ggguuauguuuacuauacaa

SEQ ID NO: 5352 - RNA, 20 nt, Artificial Sequence
  Synthetic
uuauguuuacuauacaaagg

SEQ ID NO: 5353 - RNA, 20 nt, Artificial Sequence
  Synthetic
guuuacuauacaaaggugga

SEQ ID NO: 5354 - RNA, 20 nt, Artificial Sequence
  Synthetic
uuuacuauacaaagguggaa

SEQ ID NO: 5355 - RNA, 20 nt, Artificial Sequence
  Synthetic
uuacuauacaaagguggaag

SEQ ID NO: 5356 - RNA, 20 nt, Artificial Sequence
  Synthetic
caaagguggaagggguuauc

SEQ ID NO: 5357 - RNA, 20 nt, Artificial Sequence
  Synthetic
guuaucuggccccaucuuac

SEQ ID NO: 5358 - RNA, 20 nt, Artificial Sequence
  Synthetic
acacaguuaccuguaagaug

SEQ ID NO: 5359 - RNA, 20 nt, Artificial Sequence
  Synthetic
gacacaguuaccuguaagau

SEQ ID NO: 5360 - RNA, 20 nt, Artificial Sequence
  Synthetic
ggacacaguuaccuguaaga

SEQ ID NO: 5361 - RNA, 20 nt, Artificial Sequence
  Synthetic
agguaacugugucccuuuug

SEQ ID NO: 5362 - RNA, 20 nt, Artificial Sequence
  Synthetic
ugguuuuuauauccacaaaa

SEQ ID NO: 5363 - RNA, 20 nt, Artificial Sequence
  Synthetic
augguuuuuauauccacaaa

SEQ ID NO: 5364 - RNA, 20 nt, Artificial Sequence
  Synthetic
aauaaaauugcaguaucuga

SEQ ID NO: 5365 - RNA, 20 nt, Artificial Sequence
  Synthetic
uauuuuugauuaugugucug

SEQ ID NO: 5366 - RNA, 20 nt, Artificial Sequence
  Synthetic
auuuuugauuaugugucuga

SEQ ID NO: 5367 - RNA, 20 nt, Artificial Sequence
  Synthetic
caguaugcacaucugcaugc

SEQ ID NO: 5368 - RNA, 20 nt, Artificial Sequence
  Synthetic
caucugcaugcaggugccug

SEQ ID NO: 5369 - RNA, 20 nt, Artificial Sequence
  Synthetic
caggugccuguggaagccug

SEQ ID NO: 5370 - RNA, 20 nt, Artificial Sequence
  Synthetic
augucuccacaggcuuccac

SEQ ID NO: 5371 - RNA, 20 nt, Artificial Sequence
  Synthetic
aggugaucugaugucuccac

SEQ ID NO: 5372 - RNA, 20 nt, Artificial Sequence
  Synthetic
gacaucagaucaccugaagc

SEQ ID NO: 5373 - RNA, 20 nt, Artificial Sequence
  Synthetic
ucaccugaagcuggaguuuc

SEQ ID NO: 5374 - RNA, 20 nt, Artificial Sequence
  Synthetic
cugccugaaacuccagcuuc

SEQ ID NO: 5375 - RNA, 20 nt, Artificial Sequence
  Synthetic
aguuuuaugccaccagacac

SEQ ID NO: 5376 - RNA, 20 nt, Artificial Sequence
  Synthetic
uucucagcaccagugucugg

SEQ ID NO: 5377 - RNA, 20 nt, Artificial Sequence
  Synthetic
cuauucucagcaccaguguc

SEQ ID NO: 5378 - RNA, 20 nt, Artificial Sequence
  Synthetic
auaaaauauacugcuuuugc

SEQ ID NO: 5379 - RNA, 20 nt, Artificial Sequence
  Synthetic
guugcuuuuggcuggagaga

SEQ ID NO: 5380 - RNA, 20 nt, Artificial Sequence
  Synthetic
uuuuaaagguugcuuuuggc

SEQ ID NO: 5381 - RNA, 20 nt, Artificial Sequence
  Synthetic
cagcuuuuaaagguugcuuu

SEQ ID NO: 5382 - RNA, 20 nt, Artificial Sequence
  Synthetic
aaagcaaccuuuaaaagcug

SEQ ID NO: 5383 - RNA, 20 nt, Artificial Sequence
  Synthetic
acauaaaccacagcuuuuaa

SEQ ID NO: 5384 - RNA, 20 nt, Artificial Sequence
  Synthetic
cucuaaguggaugaauuaaa

SEQ ID NO: 5385 - RNA, 20 nt, Artificial Sequence
  Synthetic
cauuuaauucauccacuuag

SEQ ID NO: 5386 - RNA, 20 nt, Artificial Sequence
  Synthetic
auuuaauucauccacuuaga

SEQ ID NO: 5387 - RNA, 20 nt, Artificial Sequence
  Synthetic
auugaaguguacccucuaag

SEQ ID NO: 5388 - RNA, 20 nt, Artificial Sequence
  Synthetic
aaaauaugcuuacagaucug

SEQ ID NO: 5389 - RNA, 20 nt, Artificial Sequence
  Synthetic
aaauaugcuuacagaucugu

SEQ ID NO: 5390 - RNA, 20 nt, Artificial Sequence
  Synthetic
ugcuaaaaggguucuaaaau

SEQ ID NO: 5391 - RNA, 20 nt, Artificial Sequence
  Synthetic
uaauaucuguagugcuaaaa

SEQ ID NO: 5392 - RNA, 20 nt, Artificial Sequence
  Synthetic
uuaauaucuguagugcuaaa

SEQ ID NO: 5393 - RNA, 20 nt, Artificial Sequence
  Synthetic
gcugggggcuggggagaaua

SEQ ID NO: 5394 - RNA, 20 nt, Artificial Sequence
  Synthetic
agcugggggcuggggagaau

SEQ ID NO: 5395 - RNA, 20 nt, Artificial Sequence
  Synthetic
gggacuggagcugggggcug

SEQ ID NO: 5396 - RNA, 20 nt, Artificial Sequence
  Synthetic
agggacuggagcugggggcu

SEQ ID NO: 5397 - RNA, 20 nt, Artificial Sequence
  Synthetic
cagggacuggagcugggggc

SEQ ID NO: 5398 - RNA, 20 nt, Artificial Sequence
  Synthetic
cagcccccagcuccaguccc

SEQ ID NO: 5399 - RNA, 20 nt, Artificial Sequence
  Synthetic
augccagggacuggagcugg

SEQ ID NO: 5400 - RNA, 20 nt, Artificial Sequence
  Synthetic
gaugccagggacuggagcug

SEQ ID NO: 5401 - RNA, 20 nt, Artificial Sequence
  Synthetic
ggaugccagggacuggagcu

SEQ ID NO: 5402 - RNA, 20 nt, Artificial Sequence
  Synthetic
uggaugccagggacuggagc

SEQ ID NO: 5403 - RNA, 20 nt, Artificial Sequence
  Synthetic
gauuuguggaugccagggac

SEQ ID NO: 5404 - RNA, 20 nt, Artificial Sequence
  Synthetic
aaggggauuuguggaugcca

SEQ ID NO: 5405 - RNA, 20 nt, Artificial Sequence
  Synthetic
gaaggggauuuguggaugcc

SEQ ID NO: 5406 - RNA, 20 nt, Artificial Sequence
  Synthetic
gauggcaggaaggggauuug

SEQ ID NO: 5407 - RNA, 20 nt, Artificial Sequence
  Synthetic
aaucuauagauggcaggaag

SEQ ID NO: 5408 - RNA, 20 nt, Artificial Sequence
  Synthetic
gaaucuauagauggcaggaa

SEQ ID NO: 5409 - RNA, 20 nt, Artificial Sequence
  Synthetic
ugaaucuauagauggcagga

SEQ ID NO: 5410 - RNA, 20 nt, Artificial Sequence
  Synthetic
gaggugaaucuauagauggc

SEQ ID NO: 5411 - RNA, 20 nt, Artificial Sequence
  Synthetic
agaagaggugaaucuauaga

SEQ ID NO: 5412 - RNA, 20 nt, Artificial Sequence
  Synthetic
uucaguguaaagucuagaag

SEQ ID NO: 5413 - RNA, 20 nt, Artificial Sequence
  Synthetic
uucuagacuuuacacugaaa

SEQ ID NO: 5414 - RNA, 20 nt, Artificial Sequence
  Synthetic
aaaugguauuacacaacaug

SEQ ID NO: 5415 - RNA, 20 nt, Artificial Sequence
  Synthetic
uugcuugccgugugucugug

SEQ ID NO: 5416 - RNA, 20 nt, Artificial Sequence
  Synthetic
agaugaaccucacagacaca

SEQ ID NO: 5417 - RNA, 20 nt, Artificial Sequence
  Synthetic
ucaucuguguugagcaugaa

SEQ ID NO: 5418 - RNA, 20 nt, Artificial Sequence
  Synthetic
uaggcgacaggcauauucau

SEQ ID NO: 5419 - RNA, 20 nt, Artificial Sequence
  Synthetic
uuaggcgacaggcauauuca

SEQ ID NO: 5420 - RNA, 20 nt, Artificial Sequence
  Synthetic
guguugcuauuuuaggcgac

SEQ ID NO: 5421 - RNA, 20 nt, Artificial Sequence
  Synthetic
ugugaaaguguugcuauuuu

SEQ ID NO: 5422 - RNA, 20 nt, Artificial Sequence
  Synthetic
ccuucuuucuucuucccaag

SEQ ID NO: 5423 - RNA, 20 nt, Artificial Sequence
  Synthetic
ccucuugggaagaagaaaga

SEQ ID NO: 5424 - RNA, 20 nt, Artificial Sequence
  Synthetic
cuucuuucuucuucccaaga

SEQ ID NO: 5425 - RNA, 20 nt, Artificial Sequence
  Synthetic
gcugcaauaaugucccucuu

SEQ ID NO: 5426 - RNA, 20 nt, Artificial Sequence
  Synthetic
ggcugcaauaaugucccucu

SEQ ID NO: 5427 - RNA, 20 nt, Artificial Sequence
  Synthetic
agacacaggagaaaacuagc

SEQ ID NO: 5428 - RNA, 20 nt, Artificial Sequence
  Synthetic
agaaacacgaaaaaagacac

SEQ ID NO: 5429 - RNA, 20 nt, Artificial Sequence
  Synthetic
cguguuucucaaguagauga

SEQ ID NO: 5430 - RNA, 20 nt, Artificial Sequence
  Synthetic
guguuucucaaguagaugaa

SEQ ID NO: 5431 - RNA, 20 nt, Artificial Sequence
  Synthetic
ucucaaguagaugaagggac

SEQ ID NO: 5432 - RNA, 20 nt, Artificial Sequence
  Synthetic
uuaggaaacugacaaagcag

SEQ ID NO: 5433 - RNA, 20 nt, Artificial Sequence
  Synthetic
uuuaggaaacugacaaagca

SEQ ID NO: 5434 - RNA, 20 nt, Artificial Sequence
  Synthetic
auuuaggaaacugacaaagc

SEQ ID NO: 5435 - RNA, 20 nt, Artificial Sequence
  Synthetic
aauacaguauucacucauuu

SEQ ID NO: 5436 - RNA, 20 nt, Artificial Sequence
  Synthetic
aaaugagugaauacuguauu

SEQ ID NO: 5437 - RNA, 20 nt, Artificial Sequence
  Synthetic
uauuuuggucuuucugauug

SEQ ID NO: 5438 - RNA, 20 nt, Artificial Sequence
  Synthetic
uuauuuuggucuuucugauu

SEQ ID NO: 5439 - RNA, 20 nt, Artificial Sequence
  Synthetic
auuauuuuggucuuucugau

SEQ ID NO: 5440 - RNA, 20 nt, Artificial Sequence
  Synthetic
gagauuauuuuaaauuauuu

SEQ ID NO: 5441 - RNA, 20 nt, Artificial Sequence
  Synthetic
aucucgucucuauaucacua

SEQ ID NO: 5442 - RNA, 20 nt, Artificial Sequence
  Synthetic
cuaagguauccuuuuccacu

SEQ ID NO: 5443 - RNA, 20 nt, Artificial Sequence
  Synthetic
uaagguauccuuuuccacuu

SEQ ID NO: 5444 - RNA, 20 nt, Artificial Sequence
  Synthetic
cugcauggcccaaguggaaa

SEQ ID NO: 5445 - RNA, 20 nt, Artificial Sequence
  Synthetic
auuucucugcauggcccaag

SEQ ID NO: 5446 - RNA, 20 nt, Artificial Sequence
  Synthetic
ggcaugcuuauuucucugca

SEQ ID NO: 5447 - RNA, 20 nt, Artificial Sequence
  Synthetic
gggugggguggggucaauca

SEQ ID NO: 5448 - RNA, 20 nt, Artificial Sequence
  Synthetic
cuggggguugggguggggug

SEQ ID NO: 5449 - RNA, 20 nt, Artificial Sequence
  Synthetic
acuggggguugggguggggu

SEQ ID NO: 5450 - RNA, 20 nt, Artificial Sequence
  Synthetic
cacuggggguuggggugggg

SEQ ID NO: 5451 - RNA, 20 nt, Artificial Sequence
  Synthetic
caccccaccccaacccccag

SEQ ID NO: 5452 - RNA, 20 nt, Artificial Sequence
  Synthetic
caccacuggggguuggggug

SEQ ID NO: 5453 - RNA, 20 nt, Artificial Sequence
  Synthetic
ucaccacuggggguuggggu

SEQ ID NO: 5454 - RNA, 20 nt, Artificial Sequence
  Synthetic
gucaccacuggggguugggg

SEQ ID NO: 5455 - RNA, 20 nt, Artificial Sequence
  Synthetic
cuugucaccacuggggguug

SEQ ID NO: 5456 - RNA, 20 nt, Artificial Sequence
  Synthetic
cccaacccccaguggugaca

SEQ ID NO: 5457 - RNA, 20 nt, Artificial Sequence
  Synthetic
ccuugucaccacuggggguu

SEQ ID NO: 5458 - RNA, 20 nt, Artificial Sequence
  Synthetic
uccuugucaccacugggggu

SEQ ID NO: 5459 - RNA, 20 nt, Artificial Sequence
  Synthetic
gagguccuugucaccacugg

SEQ ID NO: 5460 - RNA, 20 nt, Artificial Sequence
  Synthetic
ggagguccuugucaccacug

SEQ ID NO: 5461 - RNA, 20 nt, Artificial Sequence
  Synthetic
gggagguccuugucaccacu

SEQ ID NO: 5462 - RNA, 20 nt, Artificial Sequence
  Synthetic
ggggagguccuugucaccac

SEQ ID NO: 5463 - RNA, 20 nt, Artificial Sequence
  Synthetic
ggugacaaggaccuccccag

SEQ ID NO: 5464 - RNA, 20 nt, Artificial Sequence
  Synthetic
aaaugguugagccgcugggg

SEQ ID NO: 5465 - RNA, 20 nt, Artificial Sequence
  Synthetic
uucaaaugguugagccgcug

SEQ ID NO: 5466 - RNA, 20 nt, Artificial Sequence
  Synthetic
auucaaaugguugagccgcu

SEQ ID NO: 5467 - RNA, 20 nt, Artificial Sequence
  Synthetic
uauucaaaugguugagccgc

SEQ ID NO: 5468 - RNA, 20 nt, Artificial Sequence
  Synthetic
gcucaaccauuugaauaaaa

SEQ ID NO: 5469 - RNA, 20 nt, Artificial Sequence
  Synthetic
aaguguccuuuuuauucaaa

SEQ ID NO: 5470 - RNA, 20 nt, Artificial Sequence
  Synthetic
aucuuagauuugugcaaaau

SEQ ID NO: 5471 - RNA, 20 nt, Artificial Sequence
  Synthetic
caucuuagauuugugcaaaa

SEQ ID NO: 5472 - RNA, 20 nt, Artificial Sequence
  Synthetic
acaaaucuaagaugagcaag

SEQ ID NO: 5473 - RNA, 20 nt, Artificial Sequence
  Synthetic
gucaccuguaaacaugugcc

SEQ ID NO: 5474 - RNA, 20 nt, Artificial Sequence
  Synthetic
ugcuccaggcacauguuuac

SEQ ID NO: 5475 - RNA, 20 nt, Artificial Sequence
  Synthetic
guaaacaugugccuggagca

SEQ ID NO: 5476 - RNA, 20 nt, Artificial Sequence
  Synthetic
cucaggucguuccgugcucc

SEQ ID NO: 5477 - RNA, 20 nt, Artificial Sequence
  Synthetic
gagcacggaacgaccugagu

SEQ ID NO: 5478 - RNA, 20 nt, Artificial Sequence
  Synthetic
cgaccugaguaggcagaaaa

SEQ ID NO: 5479 - RNA, 20 nt, Artificial Sequence
  Synthetic
ccugaguaggcagaaaaagg

SEQ ID NO: 5480 - RNA, 20 nt, Artificial Sequence
  Synthetic
ccaccuuuuucugccuacuc

SEQ ID NO: 5481 - RNA, 20 nt, Artificial Sequence
  Synthetic
auuuaugauuuuucuuuuaa

SEQ ID NO: 5482 - RNA, 20 nt, Artificial Sequence
  Synthetic
agugagaaaggugggggaaa

SEQ ID NO: 5483 - RNA, 20 nt, Artificial Sequence
  Synthetic
uuggaaagugagaaaggugg

SEQ ID NO: 5484 - RNA, 20 nt, Artificial Sequence
  Synthetic
guuggaaagugagaaaggug

SEQ ID NO: 5485 - RNA, 20 nt, Artificial Sequence
  Synthetic
uguuggaaagugagaaaggu

SEQ ID NO: 5486 - RNA, 20 nt, Artificial Sequence
  Synthetic
uuguuggaaagugagaaagg

SEQ ID NO: 5487 - RNA, 20 nt, Artificial Sequence
  Synthetic
auauuguuggaaagugagaa

SEQ ID NO: 5488 - RNA, 20 nt, Artificial Sequence
  Synthetic
uuuccaacaauauuauauuc

SEQ ID NO: 5489 - RNA, 20 nt, Artificial Sequence
  Synthetic
acaccagaauauaauauugu

SEQ ID NO: 5490 - RNA, 20 nt, Artificial Sequence
  Synthetic
cuuuuauuccccaguuguuu

SEQ ID NO: 5491 - RNA, 20 nt, Artificial Sequence
  Synthetic
uuuaaucaccaaaacaacug

SEQ ID NO: 5492 - RNA, 20 nt, Artificial Sequence
  Synthetic
auuuaaucaccaaaacaacu

SEQ ID NO: 5493 - RNA, 20 nt, Artificial Sequence
  Synthetic
gauuuaaucaccaaaacaac

SEQ ID NO: 5494 - RNA, 20 nt, Artificial Sequence
  Synthetic
uuuuggugauuaaaucauuu

SEQ ID NO: 5495 - RNA, 20 nt, Artificial Sequence
  Synthetic
uuuggugauuaaaucauuuu

SEQ ID NO: 5496 - RNA, 20 nt, Artificial Sequence
  Synthetic
uuggugauuaaaucauuuug

SEQ ID NO: 5497 - RNA, 20 nt, Artificial Sequence
  Synthetic
uggugauuaaaucauuuugg

SEQ ID NO: 5498 - RNA, 20 nt, Artificial Sequence
  Synthetic
acucucauucacugcucccu

SEQ ID NO: 5499 - RNA, 20 nt, Artificial Sequence
  Synthetic
aaaaaaaacacugucaccaa

SEQ ID NO: 5500 - RNA, 20 nt, Artificial Sequence
  Synthetic
gaaaaaaaacacugucacca

SEQ ID NO: 5501 - RNA, 20 nt, Artificial Sequence
  Synthetic
gcagagacagagggaacagc

SEQ ID NO: 5502 - RNA, 20 nt, Artificial Sequence
  Synthetic
ugaaaaugagcagagacaga

SEQ ID NO: 5503 - RNA, 20 nt, Artificial Sequence
  Synthetic
augaaaaugagcagagacag

SEQ ID NO: 5504 - RNA, 20 nt, Artificial Sequence
  Synthetic
cugucucugcucauuuucau

SEQ ID NO: 5505 - RNA, 20 nt, Artificial Sequence
  Synthetic
ugcucauuuucauaggaauc

SEQ ID NO: 5506 - RNA, 20 nt, Artificial Sequence
  Synthetic
aucuggcaccuuagaauccc

SEQ ID NO: 5507 - RNA, 20 nt, Artificial Sequence
  Synthetic
gcaggcagccugggauucua

SEQ ID NO: 5508 - RNA, 20 nt, Artificial Sequence
  Synthetic
cauuugacugcaggcagccu

SEQ ID NO: 5509 - RNA, 20 nt, Artificial Sequence
  Synthetic
gcauuugacugcaggcagcc

SEQ ID NO: 5510 - RNA, 20 nt, Artificial Sequence
  Synthetic
ccugcagucaaaugcuugcu

SEQ ID NO: 5511 - RNA, 20 nt, Artificial Sequence
  Synthetic
ccuagcaagcauuugacugc

SEQ ID NO: 5512 - RNA, 20 nt, Artificial Sequence
  Synthetic
cugcagucaaaugcuugcua

SEQ ID NO: 5513 - RNA, 20 nt, Artificial Sequence
  Synthetic
cagucaaaugcuugcuaggg

SEQ ID NO: 5514 - RNA, 20 nt, Artificial Sequence
  Synthetic
agucaaaugcuugcuaggga

SEQ ID NO: 5515 - RNA, 20 nt, Artificial Sequence
  Synthetic
gucaaaugcuugcuagggag

SEQ ID NO: 5516 - RNA, 20 nt, Artificial Sequence
  Synthetic
uugcuagggaggggagccag

SEQ ID NO: 5517 - RNA, 20 nt, Artificial Sequence
  Synthetic
ugcuagggaggggagccagu

SEQ ID NO: 5518 - RNA, 20 nt, Artificial Sequence
  Synthetic
uagggaggggagccaguggg

SEQ ID NO: 5519 - RNA, 20 nt, Artificial Sequence
  Synthetic
agggaggggagccagugggu

SEQ ID NO: 5520 - RNA, 20 nt, Artificial Sequence
  Synthetic
gggaggggagccagugggug

SEQ ID NO: 5521 - RNA, 20 nt, Artificial Sequence
  Synthetic
ggaggggagccagugggugg

SEQ ID NO: 5522 - RNA, 20 nt, Artificial Sequence
  Synthetic
uugcagguucccccacccac

SEQ ID NO: 5523 - RNA, 20 nt, Artificial Sequence
  Synthetic
auuuggaguugauuucuugc

SEQ ID NO: 5524 - RNA, 20 nt, Artificial Sequence
  Synthetic
aaaucaacuccaaauuuaau

SEQ ID NO: 5525 - RNA, 20 nt, Artificial Sequence
  Synthetic
gagcuuaguccuauuaaauu

SEQ ID NO: 5526 - RNA, 20 nt, Artificial Sequence
  Synthetic
cugcuaaucaggcauggugu

SEQ ID NO: 5527 - RNA, 20 nt, Artificial Sequence
  Synthetic
accaugccugauuagcagcu

SEQ ID NO: 5528 - RNA, 20 nt, Artificial Sequence
  Synthetic
accuagcugcuaaucaggca

SEQ ID NO: 5529 - RNA, 20 nt, Artificial Sequence
  Synthetic
augagaccuagcugcuaauc

SEQ ID NO: 5530 - RNA, 20 nt, Artificial Sequence
  Synthetic
ggucucauccuuaccccucc

SEQ ID NO: 5531 - RNA, 20 nt, Artificial Sequence
  Synthetic
uccuuaccccuccaggaaua

SEQ ID NO: 5532 - RNA, 20 nt, Artificial Sequence
  Synthetic
uccuuauuccuggaggggua

SEQ ID NO: 5533 - RNA, 20 nt, Artificial Sequence
  Synthetic
uaccccuccaggaauaagga

SEQ ID NO: 5534 - RNA, 20 nt, Artificial Sequence
  Synthetic
aaccuuccuuauuccuggag

SEQ ID NO: 5535 - RNA, 20 nt, Artificial Sequence
  Synthetic
caaccuuccuuauuccugga

SEQ ID NO: 5536 - RNA, 20 nt, Artificial Sequence
  Synthetic
gcaaccuuccuuauuccugg

SEQ ID NO: 5537 - RNA, 20 nt, Artificial Sequence
  Synthetic
ucugcaaccuuccuuauucc

SEQ ID NO: 5538 - RNA, 20 nt, Artificial Sequence
  Synthetic
agguugcagaagucccugaa

SEQ ID NO: 5539 - RNA, 20 nt, Artificial Sequence
  Synthetic
ggcucagcaaauaccuuuca

SEQ ID NO: 5540 - RNA, 20 nt, Artificial Sequence
  Synthetic
aggcucagcaaauaccuuuc

SEQ ID NO: 5541 - RNA, 20 nt, Artificial Sequence
  Synthetic
gcugagccucuugugaaccg

SEQ ID NO: 5542 - RNA, 20 nt, Artificial Sequence
  Synthetic
cugagccucuugugaaccgu

SEQ ID NO: 5543 - RNA, 20 nt, Artificial Sequence
  Synthetic
gccucuugugaaccgugggu

SEQ ID NO: 5544 - RNA, 20 nt, Artificial Sequence
  Synthetic
gccaacccacgguucacaag

SEQ ID NO: 5545 - RNA, 20 nt, Artificial Sequence
  Synthetic
aguucaggugagccaaccca

SEQ ID NO: 5546 - RNA, 20 nt, Artificial Sequence
  Synthetic
aagaauaucuacuaaaguuc

SEQ ID NO: 5547 - RNA, 20 nt, Artificial Sequence
  Synthetic
auauucuuuagcgacauauu

SEQ ID NO: 5548 - RNA, 20 nt, Artificial Sequence
  Synthetic
uauucuuuagcgacauauuu

SEQ ID NO: 5549 - RNA, 20 nt, Artificial Sequence
  Synthetic
uuagcgacauauuugggcuu

SEQ ID NO: 5550 - RNA, 20 nt, Artificial Sequence
  Synthetic
uguggagagauaaaagagag

SEQ ID NO: 5551 - RNA, 20 nt, Artificial Sequence
  Synthetic
uuaucucuccacaaaagucu

SEQ ID NO: 5552 - RNA, 20 nt, Artificial Sequence
  Synthetic
ucaguuugccaagacuuuug

SEQ ID NO: 5553 - RNA, 20 nt, Artificial Sequence
  Synthetic
ugauguuuaugcaaccagua

SEQ ID NO: 5554 - RNA, 20 nt, Artificial Sequence
  Synthetic
uaugcaaccaguaaggccuc

SEQ ID NO: 5555 - RNA, 20 nt, Artificial Sequence
  Synthetic
augcaaccaguaaggccucu

SEQ ID NO: 5556 - RNA, 20 nt, Artificial Sequence
  Synthetic
ugcaaccaguaaggccucug

SEQ ID NO: 5557 - RNA, 20 nt, Artificial Sequence
  Synthetic
cucagccccagaggccuuac

SEQ ID NO: 5558 - RNA, 20 nt, Artificial Sequence
  Synthetic
caguaaggccucuggggcug

SEQ ID NO: 5559 - RNA, 20 nt, Artificial Sequence
  Synthetic
aguaaggccucuggggcuga

SEQ ID NO: 5560 - RNA, 20 nt, Artificial Sequence
  Synthetic
guaaggccucuggggcugag

SEQ ID NO: 5561 - RNA, 20 nt, Artificial Sequence
  Synthetic
uaaggccucuggggcugagg

SEQ ID NO: 5562 - RNA, 20 nt, Artificial Sequence
  Synthetic
ggccucuggggcugaggggg

SEQ ID NO: 5563 - RNA, 20 nt, Artificial Sequence
  Synthetic
gccucuggggcugagggggu

SEQ ID NO: 5564 - RNA, 20 nt, Artificial Sequence
  Synthetic
ucccacccccucagccccag

SEQ ID NO: 5565 - RNA, 20 nt, Artificial Sequence
  Synthetic
cugagggggugggaagccag

SEQ ID NO: 5566 - RNA, 20 nt, Artificial Sequence
  Synthetic
ugagggggugggaagccagu

SEQ ID NO: 5567 - RNA, 20 nt, Artificial Sequence
  Synthetic
gggggugggaagccaguggg

SEQ ID NO: 5568 - RNA, 20 nt, Artificial Sequence
  Synthetic
ggugggaagccagugggugg

SEQ ID NO: 5569 - RNA, 20 nt, Artificial Sequence
  Synthetic
uugcagguuccgccacccac

SEQ ID NO: 5570 - RNA, 20 nt, Artificial Sequence
  Synthetic
auuuggggcggauuucuugc

SEQ ID NO: 5571 - RNA, 20 nt, Artificial Sequence
  Synthetic
agaaauccgccccaaauuua

SEQ ID NO: 5572 - RNA, 20 nt, Artificial Sequence
  Synthetic
augcuuccuuaaauuugggg

SEQ ID NO: 5573 - RNA, 20 nt, Artificial Sequence
  Synthetic
ccccaaauuuaaggaagcau

SEQ ID NO: 5574 - RNA, 20 nt, Artificial Sequence
  Synthetic
ccuaugcuuccuuaaauuug

SEQ ID NO: 5575 - RNA, 20 nt, Artificial Sequence
  Synthetic
uccuaugcuuccuuaaauuu

SEQ ID NO: 5576 - RNA, 20 nt, Artificial Sequence
  Synthetic
uuccuaugcuuccuuaaauu

SEQ ID NO: 5577 - RNA, 20 nt, Artificial Sequence
  Synthetic
ccuacccuaugucugccuug

SEQ ID NO: 5578 - RNA, 20 nt, Artificial Sequence
  Synthetic
ccacaaggcagacauagggu

SEQ ID NO: 5579 - RNA, 20 nt, Artificial Sequence
  Synthetic
cuagccacaaggcagacaua

SEQ ID NO: 5580 - RNA, 20 nt, Artificial Sequence
  Synthetic
ccuaugucugccuuguggcu

SEQ ID NO: 5581 - RNA, 20 nt, Artificial Sequence
  Synthetic
ccuagccacaaggcagacau

SEQ ID NO: 5582 - RNA, 20 nt, Artificial Sequence
  Synthetic
gaacuaaggaccuagccaca

SEQ ID NO: 5583 - RNA, 20 nt, Artificial Sequence
  Synthetic
uccuuaguucauugucucuu

SEQ ID NO: 5584 - RNA, 20 nt, Artificial Sequence
  Synthetic
accuaagagacaaugaacua

SEQ ID NO: 5585 - RNA, 20 nt, Artificial Sequence
  Synthetic
uucuacucucaagagaaucu

SEQ ID NO: 5586 - RNA, 20 nt, Artificial Sequence
  Synthetic
cuucuacucucaagagaauc

SEQ ID NO: 5587 - RNA, 20 nt, Artificial Sequence
  Synthetic
cagauucucuugagaguaga

SEQ ID NO: 5588 - RNA, 20 nt, Artificial Sequence
  Synthetic
auucucuugagaguagaagg

SEQ ID NO: 5589 - RNA, 20 nt, Artificial Sequence
  Synthetic
ucucggauuuguuaaucagg

SEQ ID NO: 5590 - RNA, 20 nt, Artificial Sequence
  Synthetic
uccugauuaacaaauccgag

SEQ ID NO: 5591 - RNA, 20 nt, Artificial Sequence
  Synthetic
accucucggauuuguuaauc

SEQ ID NO: 5592 - RNA, 20 nt, Artificial Sequence
  Synthetic
uucaugagauuagcaccucu

SEQ ID NO: 5593 - RNA, 20 nt, Artificial Sequence
  Synthetic
gcuaaucucaugaauucucc

SEQ ID NO: 5594 - RNA, 20 nt, Artificial Sequence
  Synthetic
ucaugaauucucccggacua

SEQ ID NO: 5595 - RNA, 20 nt, Artificial Sequence
  Synthetic
gcuauauauaaccauagucc

SEQ ID NO: 5596 - RNA, 20 nt, Artificial Sequence
  Synthetic
agcuauauauaaccauaguc

SEQ ID NO: 5597 - RNA, 20 nt, Artificial Sequence
  Synthetic
ucagugaucucauguagcuu

SEQ ID NO: 5598 - RNA, 20 nt, Artificial Sequence
  Synthetic
ugaucucauguagcuuaggc

SEQ ID NO: 5599 - RNA, 20 nt, Artificial Sequence
  Synthetic
cucauguagcuuaggcuggc

SEQ ID NO: 5600 - RNA, 20 nt, Artificial Sequence
  Synthetic
uugagcucacuaugaagcaa

SEQ ID NO: 5601 - RNA, 20 nt, Artificial Sequence
  Synthetic
aaggaugacccugaacuucu

SEQ ID NO: 5602 - RNA, 20 nt, Artificial Sequence
  Synthetic
caggaaaaccaagaaguuca

SEQ ID NO: 5603 - RNA, 20 nt, Artificial Sequence
  Synthetic
gcaggaaaaccaagaaguuc

SEQ ID NO: 5604 - RNA, 20 nt, Artificial Sequence
  Synthetic
agcacuuggaagaugaaagc

SEQ ID NO: 5605 - RNA, 20 nt, Artificial Sequence
  Synthetic
auucuuguaaucgcagcacu

SEQ ID NO: 5606 - RNA, 20 nt, Artificial Sequence
  Synthetic
gcugccaugucuaguucaug

SEQ ID NO: 5607 - RNA, 20 nt, Artificial Sequence
  Synthetic
agcaccacaugaacuagaca

SEQ ID NO: 5608 - RNA, 20 nt, Artificial Sequence
  Synthetic
ugucuaguucauguggugcu

SEQ ID NO: 5609 - RNA, 20 nt, Artificial Sequence
  Synthetic
gucuaguucauguggugcua

SEQ ID NO: 5610 - RNA, 20 nt, Artificial Sequence
  Synthetic
ggugcuagggaucaacccug

SEQ ID NO: 5611 - RNA, 20 nt, Artificial Sequence
  Synthetic
uuaacaugcacaaagccuca

SEQ ID NO: 5612 - RNA, 20 nt, Artificial Sequence
  Synthetic
cuuaacaugcacaaagccuc

SEQ ID NO: 5613 - RNA, 20 nt, Artificial Sequence
  Synthetic
auucuuuugagucaggguca

SEQ ID NO: 5614 - RNA, 20 nt, Artificial Sequence
  Synthetic
uauucuuuugagucaggguc

SEQ ID NO: 5615 - RNA, 20 nt, Artificial Sequence
  Synthetic
ugacccugacucaaaagaau

SEQ ID NO: 5616 - RNA, 20 nt, Artificial Sequence
  Synthetic
gacccugacucaaaagaaua

SEQ ID NO: 5617 - RNA, 20 nt, Artificial Sequence
  Synthetic
acccugacucaaaagaauag

SEQ ID NO: 5618 - RNA, 20 nt, Artificial Sequence
  Synthetic
cccugacucaaaagaauagg

SEQ ID NO: 5619 - RNA, 20 nt, Artificial Sequence
  Synthetic
cccccuauucuuuugaguca

SEQ ID NO: 5620 - RNA, 20 nt, Artificial Sequence
  Synthetic
ccugacucaaaagaauaggg

SEQ ID NO: 5621 - RNA, 20 nt, Artificial Sequence
  Synthetic
ccccccuauucuuuugaguc

SEQ ID NO: 5622 - RNA, 20 nt, Artificial Sequence
  Synthetic
cugacucaaaagaauagggg

SEQ ID NO: 5623 - RNA, 20 nt, Artificial Sequence
  Synthetic
acucaaaagaauaggggggg

SEQ ID NO: 5624 - RNA, 20 nt, Artificial Sequence
  Synthetic
aaaagaauagggggggagga

SEQ ID NO: 5625 - RNA, 20 nt, Artificial Sequence
  Synthetic
gaauagggggggaggaagga

SEQ ID NO: 5626 - RNA, 20 nt, Artificial Sequence
  Synthetic
agggggggaggaaggaagga

SEQ ID NO: 5627 - RNA, 20 nt, Artificial Sequence
  Synthetic
ggggaggaaggaaggaagga

SEQ ID NO: 5628 - RNA, 20 nt, Artificial Sequence
  Synthetic
aggaaggaaggaaggaagga

SEQ ID NO: 5629 - RNA, 20 nt, Artificial Sequence
  Synthetic
aggaaggaaggaaggaagga

SEQ ID NO: 5630 - RNA, 20 nt, Artificial Sequence
  Synthetic
ggaaggaaggaaggaaggaa

SEQ ID NO: 5631 - RNA, 20 nt, Artificial Sequence
  Synthetic
aggaaggaaggaaggaaggg

SEQ ID NO: 5632 - RNA, 20 nt, Artificial Sequence
  Synthetic
ggaaggaaggaaggaaggga

SEQ ID NO: 5633 - RNA, 20 nt, Artificial Sequence
  Synthetic
aggaaggaaggaagggaggg

SEQ ID NO: 5634 - RNA, 20 nt, Artificial Sequence
  Synthetic
ggaaggaaggaagggaggga

SEQ ID NO: 5635 - RNA, 20 nt, Artificial Sequence
  Synthetic
aggaaggaagggagggaggg

SEQ ID NO: 5636 - RNA, 20 nt, Artificial Sequence
  Synthetic
ggaaggaagggagggaggga

SEQ ID NO: 5637 - RNA, 20 nt, Artificial Sequence
  Synthetic
aggaagggagggagggaggg

SEQ ID NO: 5638 - RNA, 20 nt, Artificial Sequence
  Synthetic
ggaagggagggagggaggga

SEQ ID NO: 5639 - RNA, 20 nt, Artificial Sequence
  Synthetic
agggagggagggagggaggg

SEQ ID NO: 5640 - RNA, 20 nt, Artificial Sequence
  Synthetic
gggagggagggagggaggga

SEQ ID NO: 5641 - RNA, 20 nt, Artificial Sequence
  Synthetic
agggagggagggagggaggg

SEQ ID NO: 5642 - RNA, 20 nt, Artificial Sequence
  Synthetic
gggagggagggagggaggga

SEQ ID NO: 5643 - RNA, 20 nt, Artificial Sequence
  Synthetic
agggagggagggagggaggg

SEQ ID NO: 5644 - RNA, 20 nt, Artificial Sequence
  Synthetic
gggagggagggagggaggga

SEQ ID NO: 5645 - RNA, 20 nt, Artificial Sequence
  Synthetic
agggagggagggagggaggg

SEQ ID NO: 5646 - RNA, 20 nt, Artificial Sequence
  Synthetic
gggagggagggagggaggga

SEQ ID NO: 5647 - RNA, 20 nt, Artificial Sequence
  Synthetic
agggagggagggagggaggg

SEQ ID NO: 5648 - RNA, 20 nt, Artificial Sequence
  Synthetic
gggagggagggagggaggga

SEQ ID NO: 5649 - RNA, 20 nt, Artificial Sequence
  Synthetic
agggagggagggagggaggg

SEQ ID NO: 5650 - RNA, 20 nt, Artificial Sequence
  Synthetic
agggagggagggagggagga

SEQ ID NO: 5651 - RNA, 20 nt, Artificial Sequence
  Synthetic
gauguugagaacaaaagcca

SEQ ID NO: 5652 - RNA, 20 nt, Artificial Sequence
  Synthetic
gaacaaaagccaaggccaac

SEQ ID NO: 5653 - RNA, 20 nt, Artificial Sequence
  Synthetic
gccaaggccaacaggugagu

SEQ ID NO: 5654 - RNA, 20 nt, Artificial Sequence
  Synthetic
ccaaggccaacaggugaguu

SEQ ID NO: 5655 - RNA, 20 nt, Artificial Sequence
  Synthetic
cccaacucaccuguuggccu

SEQ ID NO: 5656 - RNA, 20 nt, Artificial Sequence
  Synthetic
ccaacaggugaguugggauu

SEQ ID NO: 5657 - RNA, 20 nt, Artificial Sequence
  Synthetic
ccuaaucccaacucaccugu

SEQ ID NO: 5658 - RNA, 20 nt, Artificial Sequence
  Synthetic
aaaaguccuuuucauagcaa

SEQ ID NO: 5659 - RNA, 20 nt, Artificial Sequence
  Synthetic
aaaguccuuuucauagcaaa

SEQ ID NO: 5660 - RNA, 20 nt, Artificial Sequence
  Synthetic
aaguccuuuucauagcaaag

SEQ ID NO: 5661 - RNA, 20 nt, Artificial Sequence
  Synthetic
acauccccuuugcuaugaaa

SEQ ID NO: 5662 - RNA, 20 nt, Artificial Sequence
  Synthetic
uuuucauagcaaaggggaug

SEQ ID NO: 5663 - RNA, 20 nt, Artificial Sequence
  Synthetic
guggaagaagagaaguugac

SEQ ID NO: 5664 - RNA, 20 nt, Artificial Sequence
  Synthetic
agagaaguugacagguaagu

SEQ ID NO: 5665 - RNA, 20 nt, Artificial Sequence
  Synthetic
gagaaguugacagguaagua

SEQ ID NO: 5666 - RNA, 20 nt, Artificial Sequence
  Synthetic
agaaaaaagaaaaaaaucug

SEQ ID NO: 5667 - RNA, 20 nt, Artificial Sequence
  Synthetic
aagaaaaaaaucuguggacc

SEQ ID NO: 5668 - RNA, 20 nt, Artificial Sequence
  Synthetic
agaaaaaaaucuguggacca

SEQ ID NO: 5669 - RNA, 20 nt, Artificial Sequence
  Synthetic
aaaaucuguggaccagggca

SEQ ID NO: 5670 - RNA, 20 nt, Artificial Sequence
  Synthetic
cugcguuucuugccaugccc

SEQ ID NO: 5671 - RNA, 20 nt, Artificial Sequence
  Synthetic
gagcaaauguucauaaagag

SEQ ID NO: 5672 - RNA, 20 nt, Artificial Sequence
  Synthetic
caaauguucauaaagagagg

SEQ ID NO: 5673 - RNA, 20 nt, Artificial Sequence
  Synthetic
aaauguucauaaagagaggu

SEQ ID NO: 5674 - RNA, 20 nt, Artificial Sequence
  Synthetic
guucauaaagagaggugggc

SEQ ID NO: 5675 - RNA, 20 nt, Artificial Sequence
  Synthetic
cauaaagagaggugggcagg

SEQ ID NO: 5676 - RNA, 20 nt, Artificial Sequence
  Synthetic
ggugggcaggaggcagacca

SEQ ID NO: 5677 - RNA, 20 nt, Artificial Sequence
  Synthetic
ucugaugagucuugagacca

SEQ ID NO: 5678 - RNA, 20 nt, Artificial Sequence
  Synthetic
caagacucaucagagagaua

SEQ ID NO: 5679 - RNA, 20 nt, Artificial Sequence
  Synthetic
agagauaaggcaauauccug

SEQ ID NO: 5680 - RNA, 20 nt, Artificial Sequence
  Synthetic
uccugaggagcacccaucug

SEQ ID NO: 5681 - RNA, 20 nt, Artificial Sequence
  Synthetic
ccugaggagcacccaucuga

SEQ ID NO: 5682 - RNA, 20 nt, Artificial Sequence
  Synthetic
cccucagaugggugcuccuc

SEQ ID NO: 5683 - RNA, 20 nt, Artificial Sequence
  Synthetic
cugaggagcacccaucugag

SEQ ID NO: 5684 - RNA, 20 nt, Artificial Sequence
  Synthetic
uugcucaacgccccucagau

SEQ ID NO: 5685 - RNA, 20 nt, Artificial Sequence
  Synthetic
cuugcucaacgccccucaga

SEQ ID NO: 5686 - RNA, 20 nt, Artificial Sequence
  Synthetic
ucugaggggcguugagcaag

SEQ ID NO: 5687 - RNA, 20 nt, Artificial Sequence
  Synthetic
cugaggggcguugagcaagu

SEQ ID NO: 5688 - RNA, 20 nt, Artificial Sequence
  Synthetic
cauuucucugcauucacaga

SEQ ID NO: 5689 - RNA, 20 nt, Artificial Sequence
  Synthetic
uucucugcauucacagaugg

SEQ ID NO: 5690 - RNA, 20 nt, Artificial Sequence
  Synthetic
ugcaacuaucuuuagcagug

SEQ ID NO: 5691 - RNA, 20 nt, Artificial Sequence
  Synthetic
ucuuuagcagugaggcaugc

SEQ ID NO: 5692 - RNA, 20 nt, Artificial Sequence
  Synthetic
cuuuagcagugaggcaugcu

SEQ ID NO: 5693 - RNA, 20 nt, Artificial Sequence
  Synthetic
augcuggguagugcuaagag

SEQ ID NO: 5694 - RNA, 20 nt, Artificial Sequence
  Synthetic
ugcuggguagugcuaagagc

SEQ ID NO: 5695 - RNA, 20 nt, Artificial Sequence
  Synthetic
uggguagugcuaagagcggg

SEQ ID NO: 5696 - RNA, 20 nt, Artificial Sequence
  Synthetic
ggguagugcuaagagcgggc

SEQ ID NO: 5697 - RNA, 20 nt, Artificial Sequence
  Synthetic
gguagugcuaagagcgggcg

SEQ ID NO: 5698 - RNA, 20 nt, Artificial Sequence
  Synthetic
cuaagagcgggcggggucug

SEQ ID NO: 5699 - RNA, 20 nt, Artificial Sequence
  Synthetic
agcgggcggggucuguggaa

SEQ ID NO: 5700 - RNA, 20 nt, Artificial Sequence
  Synthetic
gcggggucuguggaauggag

SEQ ID NO: 5701 - RNA, 20 nt, Artificial Sequence
  Synthetic
aaugacgugguaauaaggag

SEQ ID NO: 5702 - RNA, 20 nt, Artificial Sequence
  Synthetic
aguaaaaugacgugguaaua

SEQ ID NO: 5703 - RNA, 20 nt, Artificial Sequence
  Synthetic
uaaucaaaaguaaaaugacg

SEQ ID NO: 5704 - RNA, 20 nt, Artificial Sequence
  Synthetic
cuauguaucuugccucuuga

SEQ ID NO: 5705 - RNA, 20 nt, Artificial Sequence
  Synthetic
guacuugugugaccgucaag

SEQ ID NO: 5706 - RNA, 20 nt, Artificial Sequence
  Synthetic
aguacuuccaguugaagagu

SEQ ID NO: 5707 - RNA, 20 nt, Artificial Sequence
  Synthetic
uguaaugccuacucuucaac

SEQ ID NO: 5708 - RNA, 20 nt, Artificial Sequence
  Synthetic
guugaagaguaggcauuaca

SEQ ID NO: 5709 - RNA, 20 nt, Artificial Sequence
  Synthetic
ucugcuuccaugaauauucu

SEQ ID NO: 5710 - RNA, 20 nt, Artificial Sequence
  Synthetic
cugcuuccaugaauauucua

SEQ ID NO: 5711 - RNA, 20 nt, Artificial Sequence
  Synthetic
aaugugcccuagaauauuca

SEQ ID NO: 5712 - RNA, 20 nt, Artificial Sequence
  Synthetic
cuagggcacauuuuuauucc

SEQ ID NO: 5713 - RNA, 20 nt, Artificial Sequence
  Synthetic
ugcuuucauauauuuuuucc

SEQ ID NO: 5714 - RNA, 20 nt, Artificial Sequence
  Synthetic
aaagcauuucuaauuaugaa

SEQ ID NO: 5715 - RNA, 20 nt, Artificial Sequence
  Synthetic
uuucuaauuaugaauggaau

SEQ ID NO: 5716 - RNA, 20 nt, Artificial Sequence
  Synthetic
cuaauuaugaauggaauugg

SEQ ID NO: 5717 - RNA, 20 nt, Artificial Sequence
  Synthetic
ugaauggaauuggugguuua

SEQ ID NO: 5718 - RNA, 20 nt, Artificial Sequence
  Synthetic
gaauggaauuggugguuuau

SEQ ID NO: 5719 - RNA, 20 nt, Artificial Sequence
  Synthetic
aauggaauuggugguuuaug

SEQ ID NO: 5720 - RNA, 20 nt, Artificial Sequence
  Synthetic
ggaacacauaugcucagccu

SEQ ID NO: 5721 - RNA, 20 nt, Artificial Sequence
  Synthetic
gguuuugguaauuuauucca

SEQ ID NO: 5722 - RNA, 20 nt, Artificial Sequence
  Synthetic
auaaauuaccaaaaccaaag

SEQ ID NO: 5723 - RNA, 20 nt, Artificial Sequence
  Synthetic
gagucuagccucuuugguuu

SEQ ID NO: 5724 - RNA, 20 nt, Artificial Sequence
  Synthetic
agaagggagucuagccucuu

SEQ ID NO: 5725 - RNA, 20 nt, Artificial Sequence
  Synthetic
gcuucuguugaucgguagaa

SEQ ID NO: 5726 - RNA, 20 nt, Artificial Sequence
  Synthetic
ugcuucuguugaucgguaga

SEQ ID NO: 5727 - RNA, 20 nt, Artificial Sequence
  Synthetic
ucuuauaugcuucuguugau

SEQ ID NO: 5728 - RNA, 20 nt, Artificial Sequence
  Synthetic
caacagaagcauauaagagu

SEQ ID NO: 5729 - RNA, 20 nt, Artificial Sequence
  Synthetic
uucucuacucuaccaacuug

SEQ ID NO: 5730 - RNA, 20 nt, Artificial Sequence
  Synthetic
cuacucuaccaacuuguggu

SEQ ID NO: 5731 - RNA, 20 nt, Artificial Sequence
  Synthetic
uacucuaccaacuugugguu

SEQ ID NO: 5732 - RNA, 20 nt, Artificial Sequence
  Synthetic
aacaggacccaaccacaagu

SEQ ID NO: 5733 - RNA, 20 nt, Artificial Sequence
  Synthetic
guccuguuuagaauaauaag

SEQ ID NO: 5734 - RNA, 20 nt, Artificial Sequence
  Synthetic
ugccucuuauuauucuaaac

SEQ ID NO: 5735 - RNA, 20 nt, Artificial Sequence
  Synthetic
gcaucuacauguagagcucu

SEQ ID NO: 5736 - RNA, 20 nt, Artificial Sequence
  Synthetic
ucuaggaagccauucaaugc

SEQ ID NO: 5737 - RNA, 20 nt, Artificial Sequence
  Synthetic
gguuuagauccugcauugaa

SEQ ID NO: 5738 - RNA, 20 nt, Artificial Sequence
  Synthetic
ucaaugcaggaucuaaaccu

SEQ ID NO: 5739 - RNA, 20 nt, Artificial Sequence
  Synthetic
cacagacauugcuaaagcca

SEQ ID NO: 5740 - RNA, 20 nt, Artificial Sequence
  Synthetic
uggcuuuagcaaugucugug

SEQ ID NO: 5741 - RNA, 20 nt, Artificial Sequence
  Synthetic
agcaaugucugugcgguacu

SEQ ID NO: 5742 - RNA, 20 nt, Artificial Sequence
  Synthetic
caaagaaaaccaagauuuau

SEQ ID NO: 5743 - RNA, 20 nt, Artificial Sequence
  Synthetic
aaaaccaagauuuaucggaa

SEQ ID NO: 5744 - RNA, 20 nt, Artificial Sequence
  Synthetic
accaagauuuaucggaaugg

SEQ ID NO: 5745 - RNA, 20 nt, Artificial Sequence
  Synthetic
uccaccauuccgauaaaucu

SEQ ID NO: 5746 - RNA, 20 nt, Artificial Sequence
  Synthetic
gguggacacugaaaguagac

SEQ ID NO: 5747 - RNA, 20 nt, Artificial Sequence
  Synthetic
acacugaaaguagacaggaa

SEQ ID NO: 5748 - RNA, 20 nt, Artificial Sequence
  Synthetic
ccuagugugcagugugcaga

SEQ ID NO: 5749 - RNA, 20 nt, Artificial Sequence
  Synthetic
ccaucugcacacugcacacu

SEQ ID NO: 5750 - RNA, 20 nt, Artificial Sequence
  Synthetic
gugugcagugugcagaugga

SEQ ID NO: 5751 - RNA, 20 nt, Artificial Sequence
  Synthetic
ugugcagugugcagauggaa

SEQ ID NO: 5752 - RNA, 20 nt, Artificial Sequence
  Synthetic
ugcagauggaagggcagugc

SEQ ID NO: 5753 - RNA, 20 nt, Artificial Sequence
  Synthetic
gcagauggaagggcagugcu

SEQ ID NO: 5754 - RNA, 20 nt, Artificial Sequence
  Synthetic
cagauggaagggcagugcug

SEQ ID NO: 5755 - RNA, 20 nt, Artificial Sequence
  Synthetic
uggggagaauccauugcauu

SEQ ID NO: 5756 - RNA, 20 nt, Artificial Sequence
  Synthetic
cuucuucuuuccaaaugcaa

SEQ ID NO: 5757 - RNA, 20 nt, Artificial Sequence
  Synthetic
uuagcaaaagaaaucgcaga

SEQ ID NO: 5758 - RNA, 20 nt, Artificial Sequence
  Synthetic
auuagcaaaagaaaucgcag

SEQ ID NO: 5759 - RNA, 20 nt, Artificial Sequence
  Synthetic
gcgauuucuuuugcuaaugc

SEQ ID NO: 5760 - RNA, 20 nt, Artificial Sequence
  Synthetic
aagcaaguacuacagugaaa

SEQ ID NO: 5761 - RNA, 20 nt, Artificial Sequence
  Synthetic
uucacuguaguacuugcuug

SEQ ID NO: 5762 - RNA, 20 nt, Artificial Sequence
  Synthetic
acuguaguacuugcuugugg

SEQ ID NO: 5763 - RNA, 20 nt, Artificial Sequence
  Synthetic
uguggugguuugaaugaaaa

SEQ ID NO: 5764 - RNA, 20 nt, Artificial Sequence
  Synthetic
ugaaugaaaaugguccccac

SEQ ID NO: 5765 - RNA, 20 nt, Artificial Sequence
  Synthetic
guuuucaaaaauagccugug

SEQ ID NO: 5766 - RNA, 20 nt, Artificial Sequence
  Synthetic
aguuuucaaaaauagccugu

SEQ ID NO: 5767 - RNA, 20 nt, Artificial Sequence
  Synthetic
aaguuuucaaaaauagccug

SEQ ID NO: 5768 - RNA, 20 nt, Artificial Sequence
  Synthetic
uugaaaacuugauccccagu

SEQ ID NO: 5769 - RNA, 20 nt, Artificial Sequence
  Synthetic
ccccaguuggugaaacuguu

SEQ ID NO: 5770 - RNA, 20 nt, Artificial Sequence
  Synthetic
ccaaacaguuucaccaacug

SEQ ID NO: 5771 - RNA, 20 nt, Artificial Sequence
  Synthetic
uccaaacaguuucaccaacu

SEQ ID NO: 5772 - RNA, 20 nt, Artificial Sequence
  Synthetic
uuccaaacaguuucaccaac

SEQ ID NO: 5773 - RNA, 20 nt, Artificial Sequence
  Synthetic
guuggugaaacuguuuggaa

SEQ ID NO: 5774 - RNA, 20 nt, Artificial Sequence
  Synthetic
gaaacuguuuggaaaggauu

SEQ ID NO: 5775 - RNA, 20 nt, Artificial Sequence
  Synthetic
uuggaaaggauuaggaagug

SEQ ID NO: 5776 - RNA, 20 nt, Artificial Sequence
  Synthetic
auuaggaaguguggccuugc

SEQ ID NO: 5777 - RNA, 20 nt, Artificial Sequence
  Synthetic
aaguguggccuugcuggaug

SEQ ID NO: 5778 - RNA, 20 nt, Artificial Sequence
  Synthetic
uugacagaccucauccagca

SEQ ID NO: 5779 - RNA, 20 nt, Artificial Sequence
  Synthetic
ugcuggaugaggucugucaa

SEQ ID NO: 5780 - RNA, 20 nt, Artificial Sequence
  Synthetic
uggaugaggucugucaaugg

SEQ ID NO: 5781 - RNA, 20 nt, Artificial Sequence
  Synthetic
ugaggucugucaauggcgga

SEQ ID NO: 5782 - RNA, 20 nt, Artificial Sequence
  Synthetic
gagacagagagaggcacacu

SEQ ID NO: 5783 - RNA, 20 nt, Artificial Sequence
  Synthetic
ggagacagagagaggcacac

SEQ ID NO: 5784 - RNA, 20 nt, Artificial Sequence
  Synthetic
aauaaguaggagacagagag

SEQ ID NO: 5785 - RNA, 20 nt, Artificial Sequence
  Synthetic
ucauuuuucaaucaauaagu

SEQ ID NO: 5786 - RNA, 20 nt, Artificial Sequence
  Synthetic
aauucuggauggcagagcaa

SEQ ID NO: 5787 - RNA, 20 nt, Artificial Sequence
  Synthetic
ugggugauuagaauucugga

SEQ ID NO: 5788 - RNA, 20 nt, Artificial Sequence
  Synthetic
guuuugggugauuagaauuc

SEQ ID NO: 5789 - RNA, 20 nt, Artificial Sequence
  Synthetic
uaauuaggcuauaugguuuu

SEQ ID NO: 5790 - RNA, 20 nt, Artificial Sequence
  Synthetic
uuaauuaggcuauaugguuu

SEQ ID NO: 5791 - RNA, 20 nt, Artificial Sequence
  Synthetic
caguauuuaauuaggcuaua

SEQ ID NO: 5792 - RNA, 20 nt, Artificial Sequence
  Synthetic
uauaaaaacaguauuuaauu

SEQ ID NO: 5793 - RNA, 20 nt, Artificial Sequence
  Synthetic
acuguuuuuauaaguuaccu

SEQ ID NO: 5794 - RNA, 20 nt, Artificial Sequence
  Synthetic
uuuauaaguuaccuugguca

SEQ ID NO: 5795 - RNA, 20 nt, Artificial Sequence
  Synthetic
uaccuuggucaugguacuuu

SEQ ID NO: 5796 - RNA, 20 nt, Artificial Sequence
  Synthetic
auccuaaaguaccaugacca

SEQ ID NO: 5797 - RNA, 20 nt, Artificial Sequence
  Synthetic
uaguuaagaaacuaagacau

SEQ ID NO: 5798 - RNA, 20 nt, Artificial Sequence
  Synthetic
cuuaaccaaaacaccacaga

SEQ ID NO: 5799 - RNA, 20 nt, Artificial Sequence
  Synthetic
uuaaccaaaacaccacagac

SEQ ID NO: 5800 - RNA, 20 nt, Artificial Sequence
  Synthetic
caagcccgucugugguguuu

SEQ ID NO: 5801 - RNA, 20 nt, Artificial Sequence
  Synthetic
gucauaugcaagcccgucug

SEQ ID NO: 5802 - RNA, 20 nt, Artificial Sequence
  Synthetic
gcauaugacaacaguucuag

SEQ ID NO: 5803 - RNA, 20 nt, Artificial Sequence
  Synthetic
cccugaucaaaugcccuagc

SEQ ID NO: 5804 - RNA, 20 nt, Artificial Sequence
  Synthetic
ccugcuagggcauuugauca

SEQ ID NO: 5805 - RNA, 20 nt, Artificial Sequence
  Synthetic
accugcuagggcauuugauc

SEQ ID NO: 5806 - RNA, 20 nt, Artificial Sequence
  Synthetic
aucagacacagaaccugcua

SEQ ID NO: 5807 - RNA, 20 nt, Artificial Sequence
  Synthetic
caucagacacagaaccugcu

SEQ ID NO: 5808 - RNA, 20 nt, Artificial Sequence
  Synthetic
agcagguucugugucugaug

SEQ ID NO: 5809 - RNA, 20 nt, Artificial Sequence
  Synthetic
gcagguucugugucugauga

SEQ ID NO: 5810 - RNA, 20 nt, Artificial Sequence
  Synthetic
cugugucugaugagggcugc

SEQ ID NO: 5811 - RNA, 20 nt, Artificial Sequence
  Synthetic
ugaugagggcugcugguuca

SEQ ID NO: 5812 - RNA, 20 nt, Artificial Sequence
  Synthetic
gaugagggcugcugguucau

SEQ ID NO: 5813 - RNA, 20 nt, Artificial Sequence
  Synthetic
gagggcugcugguucauggg

SEQ ID NO: 5814 - RNA, 20 nt, Artificial Sequence
  Synthetic
cuuuuucucaguguccuuac

SEQ ID NO: 5815 - RNA, 20 nt, Artificial Sequence
  Synthetic
uuucucaguguccuuacagg

SEQ ID NO: 5816 - RNA, 20 nt, Artificial Sequence
  Synthetic
ucaguguccuuacaggugga

SEQ ID NO: 5817 - RNA, 20 nt, Artificial Sequence
  Synthetic
cuggauaccuuccaccugua

SEQ ID NO: 5818 - RNA, 20 nt, Artificial Sequence
  Synthetic
uggaagguauccagcuuucu

SEQ ID NO: 5819 - RNA, 20 nt, Artificial Sequence
  Synthetic
aauauaagguccaagaaagc

SEQ ID NO: 5820 - RNA, 20 nt, Artificial Sequence
  Synthetic
ggaaugcgugcuuuaauaua

SEQ ID NO: 5821 - RNA, 20 nt, Artificial Sequence
  Synthetic
aagcuaucuacucacaucaa

SEQ ID NO: 5822 - RNA, 20 nt, Artificial Sequence
  Synthetic
gaggugcuuaaaucacuuug

SEQ ID NO: 5823 - RNA, 20 nt, Artificial Sequence
  Synthetic
ggaggugcuuaaaucacuuu

SEQ ID NO: 5824 - RNA, 20 nt, Artificial Sequence
  Synthetic
uggaggugcuuaaaucacuu

SEQ ID NO: 5825 - RNA, 20 nt, Artificial Sequence
  Synthetic
ccuccaaaacccuccgucuc

SEQ ID NO: 5826 - RNA, 20 nt, Artificial Sequence
  Synthetic
ccggagacggaggguuuugg

SEQ ID NO: 5827 - RNA, 20 nt, Artificial Sequence
  Synthetic
cauccggagacggaggguuu

SEQ ID NO: 5828 - RNA, 20 nt, Artificial Sequence
  Synthetic
ggggagcauccggagacgga

SEQ ID NO: 5829 - RNA, 20 nt, Artificial Sequence
  Synthetic
gggggagcauccggagacgg

SEQ ID NO: 5830 - RNA, 20 nt, Artificial Sequence
  Synthetic
aaugggggagcauccggaga

SEQ ID NO: 5831 - RNA, 20 nt, Artificial Sequence
  Synthetic
gucuccggaugcucccccau

SEQ ID NO: 5832 - RNA, 20 nt, Artificial Sequence
  Synthetic
uucaccaaugggggagcauc

SEQ ID NO: 5833 - RNA, 20 nt, Artificial Sequence
  Synthetic
ugaaaucuguucaccaaugg

SEQ ID NO: 5834 - RNA, 20 nt, Artificial Sequence
  Synthetic
uugaaaucuguucaccaaug

SEQ ID NO: 5835 - RNA, 20 nt, Artificial Sequence
  Synthetic
guugaaaucuguucaccaau

SEQ ID NO: 5836 - RNA, 20 nt, Artificial Sequence
  Synthetic
uguugaaaucuguucaccaa

SEQ ID NO: 5837 - RNA, 20 nt, Artificial Sequence
  Synthetic
uuucaacauagcaauugagc

SEQ ID NO: 5838 - RNA, 20 nt, Artificial Sequence
  Synthetic
caacauagcaauugagcagg

SEQ ID NO: 5839 - RNA, 20 nt, Artificial Sequence
  Synthetic
uagcaauugagcaggaggaa

SEQ ID NO: 5840 - RNA, 20 nt, Artificial Sequence
  Synthetic
cuggcugugaucaaauaauu

SEQ ID NO: 5841 - RNA, 20 nt, Artificial Sequence
  Synthetic
uuugaucacagccaguacuu

SEQ ID NO: 5842 - RNA, 20 nt, Artificial Sequence
  Synthetic
uuggguguucaccaaaguac

SEQ ID NO: 5843 - RNA, 20 nt, Artificial Sequence
  Synthetic
gugaacacccaaacccagca

SEQ ID NO: 5844 - RNA, 20 nt, Artificial Sequence
  Synthetic
uucagcuccaugcuggguuu

SEQ ID NO: 5845 - RNA, 20 nt, Artificial Sequence
  Synthetic
auucagcuccaugcuggguu

SEQ ID NO: 5846 - RNA, 20 nt, Artificial Sequence
  Synthetic
cagauauucagcuccaugcu

SEQ ID NO: 5847 - RNA, 20 nt, Artificial Sequence
  Synthetic
acagauauucagcuccaugc

SEQ ID NO: 5848 - RNA, 20 nt, Artificial Sequence
  Synthetic
cuguaaucucaguauccagc

SEQ ID NO: 5849 - RNA, 20 nt, Artificial Sequence
  Synthetic
uaaucucaguauccagcagg

SEQ ID NO: 5850 - RNA, 20 nt, Artificial Sequence
  Synthetic
aguauccagcagguggauau

SEQ ID NO: 5851 - RNA, 20 nt, Artificial Sequence
  Synthetic
guauccagcagguggauauu

SEQ ID NO: 5852 - RNA, 20 nt, Artificial Sequence
  Synthetic
uauccagcagguggauauug

SEQ ID NO: 5853 - RNA, 20 nt, Artificial Sequence
  Synthetic
auuccccaauauccaccugc

SEQ ID NO: 5854 - RNA, 20 nt, Artificial Sequence
  Synthetic
auuggggaauuaagacuuca

SEQ ID NO: 5855 - RNA, 20 nt, Artificial Sequence
  Synthetic
uaagacuucaaggccagacu

SEQ ID NO: 5856 - RNA, 20 nt, Artificial Sequence
  Synthetic
acuuacuauguagccaaguc

SEQ ID NO: 5857 - RNA, 20 nt, Artificial Sequence
  Synthetic
uaguaaguuugaugccaucc

SEQ ID NO: 5858 - RNA, 20 nt, Artificial Sequence
  Synthetic
aguaaguuugaugccauccu

SEQ ID NO: 5859 - RNA, 20 nt, Artificial Sequence
  Synthetic
ggaucucauauagcccagga

SEQ ID NO: 5860 - RNA, 20 nt, Artificial Sequence
  Synthetic
aacaggaucucauauagccc

SEQ ID NO: 5861 - RNA, 20 nt, Artificial Sequence
  Synthetic
uauuuggggguuuuggaaac

SEQ ID NO: 5862 - RNA, 20 nt, Artificial Sequence
  Synthetic
uuguuucuauuuggggguuu

SEQ ID NO: 5863 - RNA, 20 nt, Artificial Sequence
  Synthetic
uuuuuauuguuucuauuugg

SEQ ID NO: 5864 - RNA, 20 nt, Artificial Sequence
  Synthetic
uuuuuuauuguuucuauuug

SEQ ID NO: 5865 - RNA, 20 nt, Artificial Sequence
  Synthetic
uuuuuuuauuguuucuauuu

SEQ ID NO: 5866 - RNA, 20 nt, Artificial Sequence
  Synthetic
auuuuuuuauuguuucuauu

SEQ ID NO: 5867 - RNA, 20 nt, Artificial Sequence
  Synthetic
aaauagaaacaauaaaaaaa

SEQ ID NO: 5868 - RNA, 20 nt, Artificial Sequence
  Synthetic
uaggguagcagugaacauga

SEQ ID NO: 5869 - RNA, 20 nt, Artificial Sequence
  Synthetic
auguucacugcuacccuaga

SEQ ID NO: 5870 - RNA, 20 nt, Artificial Sequence
  Synthetic
caagcaaaacugaccuucua

SEQ ID NO: 5871 - RNA, 20 nt, Artificial Sequence
  Synthetic
acaagcaaaacugaccuucu

SEQ ID NO: 5872 - RNA, 20 nt, Artificial Sequence
  Synthetic
uuguaacagaugacuaacag

SEQ ID NO: 5873 - RNA, 20 nt, Artificial Sequence
  Synthetic
agaugacuaacagaggaaca

SEQ ID NO: 5874 - RNA, 20 nt, Artificial Sequence
  Synthetic
cuaacagaggaacaaggucc

SEQ ID NO: 5875 - RNA, 20 nt, Artificial Sequence
  Synthetic
agcauacugguagcucuucc

SEQ ID NO: 5876 - RNA, 20 nt, Artificial Sequence
  Synthetic
cagcauacugguagcucuuc

SEQ ID NO: 5877 - RNA, 20 nt, Artificial Sequence
  Synthetic
cggaagagcuaccaguaugc

SEQ ID NO: 5878 - RNA, 20 nt, Artificial Sequence
  Synthetic
uucauuggcagccagcauac

SEQ ID NO: 5879 - RNA, 20 nt, Artificial Sequence
  Synthetic
uaagacuucagcagcuucau

SEQ ID NO: 5880 - RNA, 20 nt, Artificial Sequence
  Synthetic
gcugaagucuuaguagauuu

SEQ ID NO: 5881 - RNA, 20 nt, Artificial Sequence
  Synthetic
cuuaguagauuuaggagcua

SEQ ID NO: 5882 - RNA, 20 nt, Artificial Sequence
  Synthetic
cuggggcugugauggaaguc

SEQ ID NO: 5883 - RNA, 20 nt, Artificial Sequence
  Synthetic
ugguggugcuggggcuguga

SEQ ID NO: 5884 - RNA, 20 nt, Artificial Sequence
  Synthetic
ucacagccccagcaccacca

SEQ ID NO: 5885 - RNA, 20 nt, Artificial Sequence
  Synthetic
cacagccccagcaccaccau

SEQ ID NO: 5886 - RNA, 20 nt, Artificial Sequence
  Synthetic
cagugcccaugguggugcug

SEQ ID NO: 5887 - RNA, 20 nt, Artificial Sequence
  Synthetic
gcagugcccaugguggugcu

SEQ ID NO: 5888 - RNA, 20 nt, Artificial Sequence
  Synthetic
ggcagugcccaugguggugc

SEQ ID NO: 5889 - RNA, 20 nt, Artificial Sequence
  Synthetic
cugcugggcagugcccaugg

SEQ ID NO: 5890 - RNA, 20 nt, Artificial Sequence
  Synthetic
agacugcugggcagugccca

SEQ ID NO: 5891 - RNA, 20 nt, Artificial Sequence
  Synthetic
cuaaaagaagauagacugcu

SEQ ID NO: 5892 - RNA, 20 nt, Artificial Sequence
  Synthetic
ccagcagucuaucuucuuuu

SEQ ID NO: 5893 - RNA, 20 nt, Artificial Sequence
  Synthetic
ccuaaaagaagauagacugc

SEQ ID NO: 5894 - RNA, 20 nt, Artificial Sequence
  Synthetic
cuaucuucuuuuaggucuuc

SEQ ID NO: 5895 - RNA, 20 nt, Artificial Sequence
  Synthetic
uuuaggucuucagguguccc

SEQ ID NO: 5896 - RNA, 20 nt, Artificial Sequence
  Synthetic
uuaggucuucaggugucccu

SEQ ID NO: 5897 - RNA, 20 nt, Artificial Sequence
  Synthetic
gugucccuggguagagaaca

SEQ ID NO: 5898 - RNA, 20 nt, Artificial Sequence
  Synthetic
gaagccuuguucucuaccca

SEQ ID NO: 5899 - RNA, 20 nt, Artificial Sequence
  Synthetic
agaagccuuguucucuaccc

SEQ ID NO: 5900 - RNA, 20 nt, Artificial Sequence
  Synthetic
aacaaggcuucugcuugcau

SEQ ID NO: 5901 - RNA, 20 nt, Artificial Sequence
  Synthetic
acaaggcuucugcuugcaua

SEQ ID NO: 5902 - RNA, 20 nt, Artificial Sequence
  Synthetic
gugagacugucacuguacug

SEQ ID NO: 5903 - RNA, 20 nt, Artificial Sequence
  Synthetic
ugugagacugucacuguacu

SEQ ID NO: 5904 - RNA, 20 nt, Artificial Sequence
  Synthetic
uugugagacugucacuguac

SEQ ID NO: 5905 - RNA, 20 nt, Artificial Sequence
  Synthetic
ucacaaugagugcagcaaug

SEQ ID NO: 5906 - RNA, 20 nt, Artificial Sequence
  Synthetic
gcagcaauguggccacagaa

SEQ ID NO: 5907 - RNA, 20 nt, Artificial Sequence
  Synthetic
cagcaauguggccacagaac

SEQ ID NO: 5908 - RNA, 20 nt, Artificial Sequence
  Synthetic
agcaauguggccacagaacg

SEQ ID NO: 5909 - RNA, 20 nt, Artificial Sequence
  Synthetic
acacacauuuccccguucug

SEQ ID NO: 5910 - RNA, 20 nt, Artificial Sequence
  Synthetic
ucaagcugaaagcuuuucac

SEQ ID NO: 5911 - RNA, 20 nt, Artificial Sequence
  Synthetic
ucucuugcuaaaugacaaag

SEQ ID NO: 5912 - RNA, 20 nt, Artificial Sequence
  Synthetic
cuaaaugacaaagugguuag

SEQ ID NO: 5913 - RNA, 20 nt, Artificial Sequence
  Synthetic
aaugacaaagugguuagagg

SEQ ID NO: 5914 - RNA, 20 nt, Artificial Sequence
  Synthetic
augacaaagugguuagagga

SEQ ID NO: 5915 - RNA, 20 nt, Artificial Sequence
  Synthetic
guguagacaaugaaagcugu

SEQ ID NO: 5916 - RNA, 20 nt, Artificial Sequence
  Synthetic
agcuuucauugucuacacuc

SEQ ID NO: 5917 - RNA, 20 nt, Artificial Sequence
  Synthetic
ucuuuugagaauuuuacagu

SEQ ID NO: 5918 - RNA, 20 nt, Artificial Sequence
  Synthetic
cuagucaacacagaaauaaa

SEQ ID NO: 5919 - RNA, 20 nt, Artificial Sequence
  Synthetic
uuuguuuuguugaaaagaag

SEQ ID NO: 5920 - RNA, 20 nt, Artificial Sequence
  Synthetic
uuguuuuguugaaaagaagu

SEQ ID NO: 5921 - RNA, 20 nt, Artificial Sequence
  Synthetic
uguuuuguugaaaagaagug

SEQ ID NO: 5922 - RNA, 20 nt, Artificial Sequence
  Synthetic
guuuuguugaaaagaagugg

SEQ ID NO: 5923 - RNA, 20 nt, Artificial Sequence
  Synthetic
uugaaaagaaguggggguuu

SEQ ID NO: 5924 - RNA, 20 nt, Artificial Sequence
  Synthetic
uggggguuuugguacugaug

SEQ ID NO: 5925 - RNA, 20 nt, Artificial Sequence
  Synthetic
ggggguuuugguacugauga

SEQ ID NO: 5926 - RNA, 20 nt, Artificial Sequence
  Synthetic
gggguuuugguacugaugag

SEQ ID NO: 5927 - RNA, 20 nt, Artificial Sequence
  Synthetic
uauguuacuuauucauucuc

SEQ ID NO: 5928 - RNA, 20 nt, Artificial Sequence
  Synthetic
cuuauucauucucagguuca

SEQ ID NO: 5929 - RNA, 20 nt, Artificial Sequence
  Synthetic
uuaaucuaucauuugucaua

SEQ ID NO: 5930 - RNA, 20 nt, Artificial Sequence
  Synthetic
uaauaaaagcaugcaaaugc

SEQ ID NO: 5931 - RNA, 20 nt, Artificial Sequence
  Synthetic
ugcaaaugcuggagcucugc

SEQ ID NO: 5932 - RNA, 20 nt, Artificial Sequence
  Synthetic
aaaugcuggagcucugcugg

SEQ ID NO: 5933 - RNA, 20 nt, Artificial Sequence
  Synthetic
ggcggaguaccugauaugca

SEQ ID NO: 5934 - RNA, 20 nt, Artificial Sequence
  Synthetic
gaucuucauccuugcauauc

SEQ ID NO: 5935 - RNA, 20 nt, Artificial Sequence
  Synthetic
gcuuuuuuauuugauuucug

SEQ ID NO: 5936 - RNA, 20 nt, Artificial Sequence
  Synthetic
agcuuuuuuauuugauuucu

SEQ ID NO: 5937 - RNA, 20 nt, Artificial Sequence
  Synthetic
cagcuuuuuuauuugauuuc

SEQ ID NO: 5938 - RNA, 20 nt, Artificial Sequence
  Synthetic
cagaaaucaaauaaaaaagc

SEQ ID NO: 5939 - RNA, 20 nt, Artificial Sequence
  Synthetic
agaaaucaaauaaaaaagcu

SEQ ID NO: 5940 - RNA, 20 nt, Artificial Sequence
  Synthetic
uaaaaaagcugggcauagug

SEQ ID NO: 5941 - RNA, 20 nt, Artificial Sequence
  Synthetic
agcugggcauagugaggaag

SEQ ID NO: 5942 - RNA, 20 nt, Artificial Sequence
  Synthetic
gcauagugaggaagaggaga

SEQ ID NO: 5943 - RNA, 20 nt, Artificial Sequence
  Synthetic
cauagugaggaagaggagau

SEQ ID NO: 5944 - RNA, 20 nt, Artificial Sequence
  Synthetic
agugaggaagaggagauggg

SEQ ID NO: 5945 - RNA, 20 nt, Artificial Sequence
  Synthetic
aggagaugggaggauuccug

SEQ ID NO: 5946 - RNA, 20 nt, Artificial Sequence
  Synthetic
gaugggaggauuccuguggc

SEQ ID NO: 5947 - RNA, 20 nt, Artificial Sequence
  Synthetic
ggaggauuccuguggcuggc

SEQ ID NO: 5948 - RNA, 20 nt, Artificial Sequence
  Synthetic
uuagcuguccagccagccac

SEQ ID NO: 5949 - RNA, 20 nt, Artificial Sequence
  Synthetic
uggaaauagaugaauaggcu

SEQ ID NO: 5950 - RNA, 20 nt, Artificial Sequence
  Synthetic
uagccuauucaucuauuucc

SEQ ID NO: 5951 - RNA, 20 nt, Artificial Sequence
  Synthetic
uggccuggaaauagaugaau

SEQ ID NO: 5952 - RNA, 20 nt, Artificial Sequence
  Synthetic
caucuauuuccaggccacua

SEQ ID NO: 5953 - RNA, 20 nt, Artificial Sequence
  Synthetic
aucuauuuccaggccacuaa

SEQ ID NO: 5954 - RNA, 20 nt, Artificial Sequence
  Synthetic
auuuccaggccacuaaggga

SEQ ID NO: 5955 - RNA, 20 nt, Artificial Sequence
  Synthetic
gguaccaucccuuaguggcc

SEQ ID NO: 5956 - RNA, 20 nt, Artificial Sequence
  Synthetic
uuuaagguaccaucccuuag

SEQ ID NO: 5957 - RNA, 20 nt, Artificial Sequence
  Synthetic
auuauuauuguuauuuuuua

SEQ ID NO: 5958 - RNA, 20 nt, Artificial Sequence
  Synthetic
acaauaauaauaaauaaaaa

SEQ ID NO: 5959 - RNA, 20 nt, Artificial Sequence
  Synthetic
uaauaaauaaaaaagguagc

SEQ ID NO: 5960 - RNA, 20 nt, Artificial Sequence
  Synthetic
aaaaagguagcugguuccug

SEQ ID NO: 5961 - RNA, 20 nt, Artificial Sequence
  Synthetic
ugguuccugaggagcaucua

SEQ ID NO: 5962 - RNA, 20 nt, Artificial Sequence
  Synthetic
gauauccuuagaugcuccuc

SEQ ID NO: 5963 - RNA, 20 nt, Artificial Sequence
  Synthetic
guaugugcacguggaguuaa

SEQ ID NO: 5964 - RNA, 20 nt, Artificial Sequence
  Synthetic
guauacaguguaugugcacg

SEQ ID NO: 5965 - RNA, 20 nt, Artificial Sequence
  Synthetic
ugcacauacacuguauacac

SEQ ID NO: 5966 - RNA, 20 nt, Artificial Sequence
  Synthetic
uuuuuuugguaaaacuugau

SEQ ID NO: 5967 - RNA, 20 nt, Artificial Sequence
  Synthetic
uuuuuuuuuuuuuuuuuuuu

SEQ ID NO: 5968 - RNA, 20 nt, Artificial Sequence
  Synthetic
aagaacacuuuauucacugu

SEQ ID NO: 5969 - RNA, 20 nt, Artificial Sequence
  Synthetic
aacacuuuauucacuguugg

SEQ ID NO: 5970 - RNA, 20 nt, Artificial Sequence
  Synthetic
acacuuuauucacuguuggu

SEQ ID NO: 5971 - RNA, 20 nt, Artificial Sequence
  Synthetic
cuguugguggguauguaaac

SEQ ID NO: 5972 - RNA, 20 nt, Artificial Sequence
  Synthetic
cucugugcugauuuucauag

SEQ ID NO: 5973 - RNA, 20 nt, Artificial Sequence
  Synthetic
cacuaugaaaaucagcacag

SEQ ID NO: 5974 - RNA, 20 nt, Artificial Sequence
  Synthetic
uuguuuuguuggagugggaa

SEQ ID NO: 5975 - RNA, 20 nt, Artificial Sequence
  Synthetic
uuuguuuuguuggaguggga

SEQ ID NO: 5976 - RNA, 20 nt, Artificial Sequence
  Synthetic
uuguuuuguuuuguuggagu

SEQ ID NO: 5977 - RNA, 20 nt, Artificial Sequence
  Synthetic
uuuguuuuguuuuguuggag

SEQ ID NO: 5978 - RNA, 20 nt, Artificial Sequence
  Synthetic
uuuguuuuguuuuguuuugu

SEQ ID NO: 5979 - RNA, 20 nt, Artificial Sequence
  Synthetic
guucuaguucuaguucuaga

SEQ ID NO: 5980 - RNA, 20 nt, Artificial Sequence
  Synthetic
aguucuaguucuaguucuag

SEQ ID NO: 5981 - RNA, 20 nt, Artificial Sequence
  Synthetic
cuagaacuacugcacgaucc

SEQ ID NO: 5982 - RNA, 20 nt, Artificial Sequence
  Synthetic
gauccagguuuaccacuccu

SEQ ID NO: 5983 - RNA, 20 nt, Artificial Sequence
  Synthetic
auaccuaggagugguaaacc

SEQ ID NO: 5984 - RNA, 20 nt, Artificial Sequence
  Synthetic
uuugaguaaauaccuaggag

SEQ ID NO: 5985 - RNA, 20 nt, Artificial Sequence
  Synthetic
acuccuagguauuuacucaa

SEQ ID NO: 5986 - RNA, 20 nt, Artificial Sequence
  Synthetic
aguccuuugaguaaauaccu

SEQ ID NO: 5987 - RNA, 20 nt, Artificial Sequence
  Synthetic
uauacgucaaccugugacag

SEQ ID NO: 5988 - RNA, 20 nt, Artificial Sequence
  Synthetic
guauaugaugccucugucac

SEQ ID NO: 5989 - RNA, 20 nt, Artificial Sequence
  Synthetic
cagaggcaucauauacaagc

SEQ ID NO: 5990 - RNA, 20 nt, Artificial Sequence
  Synthetic
agaggcaucauauacaagca

SEQ ID NO: 5991 - RNA, 20 nt, Artificial Sequence
  Synthetic
caucauauacaagcagggag

SEQ ID NO: 5992 - RNA, 20 nt, Artificial Sequence
  Synthetic
cauauacaagcagggagugg

SEQ ID NO: 5993 - RNA, 20 nt, Artificial Sequence
  Synthetic
ugaggggugggauuaaaggc

SEQ ID NO: 5994 - RNA, 20 nt, Artificial Sequence
  Synthetic
ugccuuuaaucccaccccuc

SEQ ID NO: 5995 - RNA, 20 nt, Artificial Sequence
  Synthetic
cuccugaggggugggauuaa

SEQ ID NO: 5996 - RNA, 20 nt, Artificial Sequence
  Synthetic
cuuuaaucccaccccucagg

SEQ ID NO: 5997 - RNA, 20 nt, Artificial Sequence
  Synthetic
gacucugccuccugaggggu

SEQ ID NO: 5998 - RNA, 20 nt, Artificial Sequence
  Synthetic
ugacucugccuccugagggg

SEQ ID NO: 5999 - RNA, 20 nt, Artificial Sequence
  Synthetic
accccucaggaggcagaguc

SEQ ID NO: 6000 - RNA, 20 nt, Artificial Sequence
  Synthetic
accugacucugccuccugag

SEQ ID NO: 6001 - RNA, 20 nt, Artificial Sequence
  Synthetic
uaccugacucugccuccuga

SEQ ID NO: 6002 - RNA, 20 nt, Artificial Sequence
  Synthetic
cuaccugacucugccuccug

SEQ ID NO: 6003 - RNA, 20 nt, Artificial Sequence
  Synthetic
gguagaucucugugaguucg

SEQ ID NO: 6004 - RNA, 20 nt, Artificial Sequence
  Synthetic
cugugaguucgaggccaguu

SEQ ID NO: 6005 - RNA, 20 nt, Artificial Sequence
  Synthetic
acucacuauguagaccaaac

SEQ ID NO: 6006 - RNA, 20 nt, Artificial Sequence
  Synthetic
cauauggcuauauggucuua

SEQ ID NO: 6007 - RNA, 20 nt, Artificial Sequence
  Synthetic
cauaagaccauauagccaua

SEQ ID NO: 6008 - RNA, 20 nt, Artificial Sequence
  Synthetic
aagaccauauagccauaugg

SEQ ID NO: 6009 - RNA, 20 nt, Artificial Sequence
  Synthetic
agaccauauagccauaugga

SEQ ID NO: 6010 - RNA, 20 nt, Artificial Sequence
  Synthetic
gaccauauagccauauggag

SEQ ID NO: 6011 - RNA, 20 nt, Artificial Sequence
  Synthetic
accauauagccauauggagg

SEQ ID NO: 6012 - RNA, 20 nt, Artificial Sequence
  Synthetic
ccauauagccauauggaggg

SEQ ID NO: 6013 - RNA, 20 nt, Artificial Sequence
  Synthetic
ccccccuccauauggcuaua

SEQ ID NO: 6014 - RNA, 20 nt, Artificial Sequence
  Synthetic
cucacaauccccccuccaua

SEQ ID NO: 6015 - RNA, 20 nt, Artificial Sequence
  Synthetic
gagagaauuauuaaaugaau

SEQ ID NO: 6016 - RNA, 20 nt, Artificial Sequence
  Synthetic
uauacacugucuucuuucau

SEQ ID NO: 6017 - RNA, 20 nt, Artificial Sequence
  Synthetic
cauaggaaaaaugaacagaa

SEQ ID NO: 6018 - RNA, 20 nt, Artificial Sequence
  Synthetic
auaggaaaaaugaacagaaa

SEQ ID NO: 6019 - RNA, 20 nt, Artificial Sequence
  Synthetic
aacagaaagggagagaucuu

SEQ ID NO: 6020 - RNA, 20 nt, Artificial Sequence
  Synthetic
acagaaagggagagaucuuu

SEQ ID NO: 6021 - RNA, 20 nt, Artificial Sequence
  Synthetic
gaaagggagagaucuuuggg

SEQ ID NO: 6022 - RNA, 20 nt, Artificial Sequence
  Synthetic
aaagggagagaucuuugggu

SEQ ID NO: 6023 - RNA, 20 nt, Artificial Sequence
  Synthetic
aagggagagaucuuugggug

SEQ ID NO: 6024 - RNA, 20 nt, Artificial Sequence
  Synthetic
auacaugacaugaaagcaga

SEQ ID NO: 6025 - RNA, 20 nt, Artificial Sequence
  Synthetic
uacaugacaugaaagcagaa

SEQ ID NO: 6026 - RNA, 20 nt, Artificial Sequence
  Synthetic
acaugacaugaaagcagaag

SEQ ID NO: 6027 - RNA, 20 nt, Artificial Sequence
  Synthetic
agcagaaggggauuaguuau

SEQ ID NO: 6028 - RNA, 20 nt, Artificial Sequence
  Synthetic
gaaggggauuaguuauugga

SEQ ID NO: 6029 - RNA, 20 nt, Artificial Sequence
  Synthetic
gggauuaguuauuggaaggc

SEQ ID NO: 6030 - RNA, 20 nt, Artificial Sequence
  Synthetic
ggauuaguuauuggaaggca

SEQ ID NO: 6031 - RNA, 20 nt, Artificial Sequence
  Synthetic
uuaguuauuggaaggcaggg

SEQ ID NO: 6032 - RNA, 20 nt, Artificial Sequence
  Synthetic
uaguuauuggaaggcaggga

SEQ ID NO: 6033 - RNA, 20 nt, Artificial Sequence
  Synthetic
uggaaggcagggagggaccc

SEQ ID NO: 6034 - RNA, 20 nt, Artificial Sequence
  Synthetic
aaggcagggagggacccagg

SEQ ID NO: 6035 - RNA, 20 nt, Artificial Sequence
  Synthetic
ggagggacccaggaggauga

SEQ ID NO: 6036 - RNA, 20 nt, Artificial Sequence
  Synthetic
gagggacccaggaggaugaa

SEQ ID NO: 6037 - RNA, 20 nt, Artificial Sequence
  Synthetic
ucucuucccuucauccuccu

SEQ ID NO: 6038 - RNA, 20 nt, Artificial Sequence
  Synthetic
uucucuucccuucauccucc

SEQ ID NO: 6039 - RNA, 20 nt, Artificial Sequence
  Synthetic
gaugaagggaagagaaugca

SEQ ID NO: 6040 - RNA, 20 nt, Artificial Sequence
  Synthetic
augaagggaagagaaugcaa

SEQ ID NO: 6041 - RNA, 20 nt, Artificial Sequence
  Synthetic
gggaagagaaugcaagggaa

SEQ ID NO: 6042 - RNA, 20 nt, Artificial Sequence
  Synthetic
aaugcaagggaaaggaguaa

SEQ ID NO: 6043 - RNA, 20 nt, Artificial Sequence
  Synthetic
gcaagggaaaggaguaaagg

SEQ ID NO: 6044 - RNA, 20 nt, Artificial Sequence
  Synthetic
agggaaaggaguaaaggagg

SEQ ID NO: 6045 - RNA, 20 nt, Artificial Sequence
  Synthetic
gaaaggaguaaaggaggagg

SEQ ID NO: 6046 - RNA, 20 nt, Artificial Sequence
  Synthetic
aguaaaggaggaggagguag

SEQ ID NO: 6047 - RNA, 20 nt, Artificial Sequence
  Synthetic
uauuaauuccagcacuugug

SEQ ID NO: 6048 - RNA, 20 nt, Artificial Sequence
  Synthetic
uaauuccagcacuugugagg

SEQ ID NO: 6049 - RNA, 20 nt, Artificial Sequence
  Synthetic
aauuccagcacuugugagga

SEQ ID NO: 6050 - RNA, 20 nt, Artificial Sequence
  Synthetic
auuccagcacuugugaggag

SEQ ID NO: 6051 - RNA, 20 nt, Artificial Sequence
  Synthetic
uguccccuccucacaagugc

SEQ ID NO: 6052 - RNA, 20 nt, Artificial Sequence
  Synthetic
gacagagcucugugaguuca

SEQ ID NO: 6053 - RNA, 20 nt, Artificial Sequence
  Synthetic
uggaacugacuaugcagagg

SEQ ID NO: 6054 - RNA, 20 nt, Artificial Sequence
  Synthetic
cuggaacugacuaugcagag

SEQ ID NO: 6055 - RNA, 20 nt, Artificial Sequence
  Synthetic
cccucugcauagucaguucc

SEQ ID NO: 6056 - RNA, 20 nt, Artificial Sequence
  Synthetic
ccuggaacugacuaugcaga

SEQ ID NO: 6057 - RNA, 20 nt, Artificial Sequence
  Synthetic
uccuggaacugacuaugcag

SEQ ID NO: 6058 - RNA, 20 nt, Artificial Sequence
  Synthetic
gucaguuccaggauagccaa

SEQ ID NO: 6059 - RNA, 20 nt, Artificial Sequence
  Synthetic
uauguagccauuggcuaucc

SEQ ID NO: 6060 - RNA, 20 nt, Artificial Sequence
  Synthetic
gggucucauuauguagccau

SEQ ID NO: 6061 - RNA, 20 nt, Artificial Sequence
  Synthetic
augagacccugugucagaga

SEQ ID NO: 6062 - RNA, 20 nt, Artificial Sequence
  Synthetic
agacccugugucagagaagg

SEQ ID NO: 6063 - RNA, 20 nt, Artificial Sequence
  Synthetic
cggccaccuucucugacaca

SEQ ID NO: 6064 - RNA, 20 nt, Artificial Sequence
  Synthetic
ccugugucagagaagguggc

SEQ ID NO: 6065 - RNA, 20 nt, Artificial Sequence
  Synthetic
ccggccaccuucucugacac

SEQ ID NO: 6066 - RNA, 20 nt, Artificial Sequence
  Synthetic
gucagagaagguggccggcg

SEQ ID NO: 6067 - RNA, 20 nt, Artificial Sequence
  Synthetic
ucagagaagguggccggcga

SEQ ID NO: 6068 - RNA, 20 nt, Artificial Sequence
  Synthetic
uaagcaucaauaucccucgc

SEQ ID NO: 6069 - RNA, 20 nt, Artificial Sequence
  Synthetic
uaacucauucagcugugugg

SEQ ID NO: 6070 - RNA, 20 nt, Artificial Sequence
  Synthetic
guuuaacucauucagcugug

SEQ ID NO: 6071 - RNA, 20 nt, Artificial Sequence
  Synthetic
agugcaaaaguagcaggaac

SEQ ID NO: 6072 - RNA, 20 nt, Artificial Sequence
  Synthetic
auugaaagugcaaaaguagc

SEQ ID NO: 6073 - RNA, 20 nt, Artificial Sequence
  Synthetic
augcucccagauuacuuaca

SEQ ID NO: 6074 - RNA, 20 nt, Artificial Sequence
  Synthetic
aaauuccauguaaguaaucu

SEQ ID NO: 6075 - RNA, 20 nt, Artificial Sequence
  Synthetic
uaaauuccauguaaguaauc

SEQ ID NO: 6076 - RNA, 20 nt, Artificial Sequence
  Synthetic
auggaauuuauauuuuauug

SEQ ID NO: 6077 - RNA, 20 nt, Artificial Sequence
  Synthetic
gagguuugucuaugauguac

SEQ ID NO: 6078 - RNA, 20 nt, Artificial Sequence
  Synthetic
uugguugaaaauuuuucuug

SEQ ID NO: 6079 - RNA, 20 nt, Artificial Sequence
  Synthetic
aaauuuucaaccaauagucc

SEQ ID NO: 6080 - RNA, 20 nt, Artificial Sequence
  Synthetic
guuauuuuugccuggacuau

SEQ ID NO: 6081 - RNA, 20 nt, Artificial Sequence
  Synthetic
aaaaagagguuauuuuugcc

SEQ ID NO: 6082 - RNA, 20 nt, Artificial Sequence
  Synthetic
agaaagaaagaaagaaaaag

SEQ ID NO: 6083 - RNA, 20 nt, Artificial Sequence
  Synthetic
ucuuuuuuuuuuuuuuuuuu

SEQ ID NO: 6084 - RNA, 20 nt, Artificial Sequence
  Synthetic
uuuuuuugguuuuuugaaac

SEQ ID NO: 6085 - RNA, 20 nt, Artificial Sequence
  Synthetic
uuuuuugguuuuuugaaaca

SEQ ID NO: 6086 - RNA, 20 nt, Artificial Sequence
  Synthetic
aggguuucucuguauagccc

SEQ ID NO: 6087 - RNA, 20 nt, Artificial Sequence
  Synthetic
cuguauagcccuggcugucc

SEQ ID NO: 6088 - RNA, 20 nt, Artificial Sequence
  Synthetic
agugaguuccaggacagcca

SEQ ID NO: 6089 - RNA, 20 nt, Artificial Sequence
  Synthetic
aagugaguuccaggacagcc

SEQ ID NO: 6090 - RNA, 20 nt, Artificial Sequence
  Synthetic
ugguguacaaagugaguucc

SEQ ID NO: 6091 - RNA, 20 nt, Artificial Sequence
  Synthetic
uggaacucacuuuguacacc

SEQ ID NO: 6092 - RNA, 20 nt, Artificial Sequence
  Synthetic
acucacuuuguacaccaggc

SEQ ID NO: 6093 - RNA, 20 nt, Artificial Sequence
  Synthetic
uucugaguucgaggccagcc

SEQ ID NO: 6094 - RNA, 20 nt, Artificial Sequence
  Synthetic
cagguggauuucugaguucg

SEQ ID NO: 6095 - RNA, 20 nt, Artificial Sequence
  Synthetic
acucgggaggcagaggcagg

SEQ ID NO: 6096 - RNA, 20 nt, Artificial Sequence
  Synthetic
agcacucgggaggcagaggc

SEQ ID NO: 6097 - RNA, 20 nt, Artificial Sequence
  Synthetic
gccucugccucccgagugcu

SEQ ID NO: 6098 - RNA, 20 nt, Artificial Sequence
  Synthetic
uccgagcacucgggaggcag

SEQ ID NO: 6099 - RNA, 20 nt, Artificial Sequence
  Synthetic
cuuuaauccgagcacucggg

SEQ ID NO: 6100 - RNA, 20 nt, Artificial Sequence
  Synthetic
cucccgagugcucggauuaa

SEQ ID NO: 6101 - RNA, 20 nt, Artificial Sequence
  Synthetic
cgccuuuaauccgagcacuc

SEQ ID NO: 6102 - RNA, 20 nt, Artificial Sequence
  Synthetic
acgccuuuaauccgagcacu

SEQ ID NO: 6103 - RNA, 20 nt, Artificial Sequence
  Synthetic
uauuuuuugcgggacggugg

SEQ ID NO: 6104 - RNA, 20 nt, Artificial Sequence
  Synthetic
gguuauuuuuugcgggacgg

SEQ ID NO: 6105 - RNA, 20 nt, Artificial Sequence
  Synthetic
acagguuauuuuuugcggga

SEQ ID NO: 6106 - RNA, 20 nt, Artificial Sequence
  Synthetic
aaaaacagguuauuuuuugc

SEQ ID NO: 6107 - RNA, 20 nt, Artificial Sequence
  Synthetic
caaaaacagguuauuuuuug

SEQ ID NO: 6108 - RNA, 20 nt, Artificial Sequence
  Synthetic
auaauuaaaacaacaaaaac

SEQ ID NO: 6109 - RNA, 20 nt, Artificial Sequence
  Synthetic
uuuuuaagauuuuaugugua

SEQ ID NO: 6110 - RNA, 20 nt, Artificial Sequence
  Synthetic
uuuuaagauuuuauguguau

SEQ ID NO: 6111 - RNA, 20 nt, Artificial Sequence
  Synthetic
cuguguaccacuuguaugcu

SEQ ID NO: 6112 - RNA, 20 nt, Artificial Sequence
  Synthetic
uugggcaccaagcauacaag

SEQ ID NO: 6113 - RNA, 20 nt, Artificial Sequence
  Synthetic
uguaugcuuggugcccaaga

SEQ ID NO: 6114 - RNA, 20 nt, Artificial Sequence
  Synthetic
ugaucuguucuguccuucuu

SEQ ID NO: 6115 - RNA, 20 nt, Artificial Sequence
  Synthetic
augaucuguucuguccuucu

SEQ ID NO: 6116 - RNA, 20 nt, Artificial Sequence
  Synthetic
agaaggacagaacagaucau

SEQ ID NO: 6117 - RNA, 20 nt, Artificial Sequence
  Synthetic
gaaggacagaacagaucaua

SEQ ID NO: 6118 - RNA, 20 nt, Artificial Sequence
  Synthetic
gaacagaucauaggguuucc

SEQ ID NO: 6119 - RNA, 20 nt, Artificial Sequence
  Synthetic
aacagaucauaggguuuccu

SEQ ID NO: 6120 - RNA, 20 nt, Artificial Sequence
  Synthetic
uuuccugggauaagaguuau

SEQ ID NO: 6121 - RNA, 20 nt, Artificial Sequence
  Synthetic
acuccuauaacucuuauccc

SEQ ID NO: 6122 - RNA, 20 nt, Artificial Sequence
  Synthetic
gaugacuguaagccaccaag

SEQ ID NO: 6123 - RNA, 20 nt, Artificial Sequence
  Synthetic
guaagccaccaaguggacgc

SEQ ID NO: 6124 - RNA, 20 nt, Artificial Sequence
  Synthetic
uaagccaccaaguggacgcu

SEQ ID NO: 6125 - RNA, 20 nt, Artificial Sequence
  Synthetic
aauucccagcguccacuugg

SEQ ID NO: 6126 - RNA, 20 nt, Artificial Sequence
  Synthetic
uucaauucccagcguccacu

SEQ ID NO: 6127 - RNA, 20 nt, Artificial Sequence
  Synthetic
ggacgcugggaauugaaccu

SEQ ID NO: 6128 - RNA, 20 nt, Artificial Sequence
  Synthetic
ggaauugaaccuugguuagc

SEQ ID NO: 6129 - RNA, 20 nt, Artificial Sequence
  Synthetic
gacacucuuccagcuaacca

SEQ ID NO: 6130 - RNA, 20 nt, Artificial Sequence
  Synthetic
gggacuggaauuaaaaauac

SEQ ID NO: 6131 - RNA, 20 nt, Artificial Sequence
  Synthetic
cauagacaaacaacggggac

SEQ ID NO: 6132 - RNA, 20 nt, Artificial Sequence
  Synthetic
aucuucauagacaaacaacg

SEQ ID NO: 6133 - RNA, 20 nt, Artificial Sequence
  Synthetic
aaucuucauagacaaacaac

SEQ ID NO: 6134 - RNA, 20 nt, Artificial Sequence
  Synthetic
aaaucuucauagacaaacaa

SEQ ID NO: 6135 - RNA, 20 nt, Artificial Sequence
  Synthetic
uugucuaugaagauuuugcu

SEQ ID NO: 6136 - RNA, 20 nt, Artificial Sequence
  Synthetic
uuuugcuugguaguccaguc

SEQ ID NO: 6137 - RNA, 20 nt, Artificial Sequence
  Synthetic
ccagucuggcuuuaagaaac

SEQ ID NO: 6138 - RNA, 20 nt, Artificial Sequence
  Synthetic
ccuguuucuuaaagccagac

SEQ ID NO: 6139 - RNA, 20 nt, Artificial Sequence
  Synthetic
cagucuggcuuuaagaaaca

SEQ ID NO: 6140 - RNA, 20 nt, Artificial Sequence
  Synthetic
aacagggucucaugcauccc

SEQ ID NO: 6141 - RNA, 20 nt, Artificial Sequence
  Synthetic
auggaagucugagcaagcca

SEQ ID NO: 6142 - RNA, 20 nt, Artificial Sequence
  Synthetic
cauggaagucugagcaagcc

SEQ ID NO: 6143 - RNA, 20 nt, Artificial Sequence
  Synthetic
cucagacuuccaugcagcug

SEQ ID NO: 6144 - RNA, 20 nt, Artificial Sequence
  Synthetic
gacuuccaugcagcugagga

SEQ ID NO: 6145 - RNA, 20 nt, Artificial Sequence
  Synthetic
uaaagccauccucagcugca

SEQ ID NO: 6146 - RNA, 20 nt, Artificial Sequence
  Synthetic
ucuacgaggaaaaggcagga

SEQ ID NO: 6147 - RNA, 20 nt, Artificial Sequence
  Synthetic
cucuacgaggaaaaggcagg

SEQ ID NO: 6148 - RNA, 20 nt, Artificial Sequence
  Synthetic
gcacucuacgaggaaaaggc

SEQ ID NO: 6149 - RNA, 20 nt, Artificial Sequence
  Synthetic
cucagcacucuacgaggaaa

SEQ ID NO: 6150 - RNA, 20 nt, Artificial Sequence
  Synthetic
uguaaucucagcacucuacg

SEQ ID NO: 6151 - RNA, 20 nt, Artificial Sequence
  Synthetic
gagaagucugcugguggcac

SEQ ID NO: 6152 - RNA, 20 nt, Artificial Sequence
  Synthetic
uguuaggagaagucugcugg

SEQ ID NO: 6153 - RNA, 20 nt, Artificial Sequence
  Synthetic
ucuuguuaggagaagucugc

SEQ ID NO: 6154 - RNA, 20 nt, Artificial Sequence
  Synthetic
gacuucuccuaacaagaaug

SEQ ID NO: 6155 - RNA, 20 nt, Artificial Sequence
  Synthetic
uccuaacaagaauguggcac

SEQ ID NO: 6156 - RNA, 20 nt, Artificial Sequence
  Synthetic
ccuaacaagaauguggcaca

SEQ ID NO: 6157 - RNA, 20 nt, Artificial Sequence
  Synthetic
cccugugccacauucuuguu

SEQ ID NO: 6158 - RNA, 20 nt, Artificial Sequence
  Synthetic
aacaagaauguggcacaggg

SEQ ID NO: 6159 - RNA, 20 nt, Artificial Sequence
  Synthetic
auguggcacagggaggcaac

SEQ ID NO: 6160 - RNA, 20 nt, Artificial Sequence
  Synthetic
uguggcacagggaggcaacu

SEQ ID NO: 6161 - RNA, 20 nt, Artificial Sequence
  Synthetic
gaggcaacugggaaucaaac

SEQ ID NO: 6162 - RNA, 20 nt, Artificial Sequence
  Synthetic
caacugggaaucaaacagga

SEQ ID NO: 6163 - RNA, 20 nt, Artificial Sequence
  Synthetic
cugggaaucaaacaggaagg

SEQ ID NO: 6164 - RNA, 20 nt, Artificial Sequence
  Synthetic
aaacaggaaggaggaguaaa

SEQ ID NO: 6165 - RNA, 20 nt, Artificial Sequence
  Synthetic
aggaaggaggaguaaaagga

SEQ ID NO: 6166 - RNA, 20 nt, Artificial Sequence
  Synthetic
ggaaggaggaguaaaaggaa

SEQ ID NO: 6167 - RNA, 20 nt, Artificial Sequence
  Synthetic
gaaggaggaguaaaaggaag

SEQ ID NO: 6168 - RNA, 20 nt, Artificial Sequence
  Synthetic
ggaggaguaaaaggaagggg

SEQ ID NO: 6169 - RNA, 20 nt, Artificial Sequence
  Synthetic
gaguaaaaggaaggggagga

SEQ ID NO: 6170 - RNA, 20 nt, Artificial Sequence
  Synthetic
aaaggaaggggaggaaggag

SEQ ID NO: 6171 - RNA, 20 nt, Artificial Sequence
  Synthetic
gggaggaaggagaggagaag

SEQ ID NO: 6172 - RNA, 20 nt, Artificial Sequence
  Synthetic
ggaaggagaggagaaguggc

SEQ ID NO: 6173 - RNA, 20 nt, Artificial Sequence
  Synthetic
aggagaggagaaguggcagg

SEQ ID NO: 6174 - RNA, 20 nt, Artificial Sequence
  Synthetic
guggcaggaggagaagaaaa

SEQ ID NO: 6175 - RNA, 20 nt, Artificial Sequence
  Synthetic
gcaggaggagaagaaaaagg

SEQ ID NO: 6176 - RNA, 20 nt, Artificial Sequence
  Synthetic
ggaggagaagaaaaaggagg

SEQ ID NO: 6177 - RNA, 20 nt, Artificial Sequence
  Synthetic
agaaaaaggaggcggagaaa

SEQ ID NO: 6178 - RNA, 20 nt, Artificial Sequence
  Synthetic
aaaaggaggcggagaaaagg

SEQ ID NO: 6179 - RNA, 20 nt, Artificial Sequence
  Synthetic
aggcggagaaaaggugguag

SEQ ID NO: 6180 - RNA, 20 nt, Artificial Sequence
  Synthetic
cggagaaaaggugguagugg

SEQ ID NO: 6181 - RNA, 20 nt, Artificial Sequence
  Synthetic
agaaaaggugguaguggugg

SEQ ID NO: 6182 - RNA, 20 nt, Artificial Sequence
  Synthetic
ggugguagugguggaggaag

SEQ ID NO: 6183 - RNA, 20 nt, Artificial Sequence
  Synthetic
gguagugguggaggaagagg

SEQ ID NO: 6184 - RNA, 20 nt, Artificial Sequence
  Synthetic
agugguggaggaagaggagg

SEQ ID NO: 6185 - RNA, 20 nt, Artificial Sequence
  Synthetic
gguggaggaagaggaggagg

SEQ ID NO: 6186 - RNA, 20 nt, Artificial Sequence
  Synthetic
ggaggaagaggaggaggagg

SEQ ID NO: 6187 - RNA, 20 nt, Artificial Sequence
  Synthetic
ggaagaggaggaggaggagg

SEQ ID NO: 6188 - RNA, 20 nt, Artificial Sequence
  Synthetic
agaggaggaggaggaggagg

SEQ ID NO: 6189 - RNA, 20 nt, Artificial Sequence
  Synthetic
ggaggaggaggaggaggagg

SEQ ID NO: 6190 - RNA, 20 nt, Artificial Sequence
  Synthetic
ggaggaggaggaggaggagg

SEQ ID NO: 6191 - RNA, 20 nt, Artificial Sequence
  Synthetic
gaggaggaggaggaggagga

SEQ ID NO: 6192 - RNA, 20 nt, Artificial Sequence
  Synthetic
aggaggaggaggaggaggag

SEQ ID NO: 6193 - RNA, 20 nt, Artificial Sequence
  Synthetic
ggaggaggaggaggaggagg

SEQ ID NO: 6194 - RNA, 20 nt, Artificial Sequence
  Synthetic
gagggggacuuaaucaguaa

SEQ ID NO: 6195 - RNA, 20 nt, Artificial Sequence
  Synthetic
acuuaaucaguaaaggaaaa

SEQ ID NO: 6196 - RNA, 20 nt, Artificial Sequence
  Synthetic
aaaaggcugagcucaguccu

SEQ ID NO: 6197 - RNA, 20 nt, Artificial Sequence
  Synthetic
cucaguccuuggaaccuaca

SEQ ID NO: 6198 - RNA, 20 nt, Artificial Sequence
  Synthetic
guccuuggaaccuacauggu

SEQ ID NO: 6199 - RNA, 20 nt, Artificial Sequence
  Synthetic
cuccuaccauguagguucca

SEQ ID NO: 6200 - RNA, 20 nt, Artificial Sequence
  Synthetic
cucauucucuccuaccaugu

SEQ ID NO: 6201 - RNA, 20 nt, Artificial Sequence
  Synthetic
guuuccucugauccccacac

SEQ ID NO: 6202 - RNA, 20 nt, Artificial Sequence
  Synthetic
ugcuccaguguggggaucag

SEQ ID NO: 6203 - RNA, 20 nt, Artificial Sequence
  Synthetic
ugauccccacacuggagcaa

SEQ ID NO: 6204 - RNA, 20 nt, Artificial Sequence
  Synthetic
ggcaccauugcuccagugug

SEQ ID NO: 6205 - RNA, 20 nt, Artificial Sequence
  Synthetic
uggcaccauugcuccagugu

SEQ ID NO: 6206 - RNA, 20 nt, Artificial Sequence
  Synthetic
auggcaccauugcuccagug

SEQ ID NO: 6207 - RNA, 20 nt, Artificial Sequence
  Synthetic
gaagugggagagugauguga

SEQ ID NO: 6208 - RNA, 20 nt, Artificial Sequence
  Synthetic
ugugaggaguugggugaagu

SEQ ID NO: 6209 - RNA, 20 nt, Artificial Sequence
  Synthetic
uugugaggaguugggugaag

SEQ ID NO: 6210 - RNA, 20 nt, Artificial Sequence
  Synthetic
uuuuauuuuugugaggaguu

SEQ ID NO: 6211 - RNA, 20 nt, Artificial Sequence
  Synthetic
uuuuuauuuuugugaggagu

SEQ ID NO: 6212 - RNA, 20 nt, Artificial Sequence
  Synthetic
uuuuguuuuuuauuuuugug

SEQ ID NO: 6213 - RNA, 20 nt, Artificial Sequence
  Synthetic
uuaaaaaagaaagcuguagc

SEQ ID NO: 6214 - RNA, 20 nt, Artificial Sequence
  Synthetic
uaaaaaagaaagcuguagcc

SEQ ID NO: 6215 - RNA, 20 nt, Artificial Sequence
  Synthetic
aagaaagcuguagccgggcg

SEQ ID NO: 6216 - RNA, 20 nt, Artificial Sequence
  Synthetic
aaagcuguagccgggcgugg

SEQ ID NO: 6217 - RNA, 20 nt, Artificial Sequence
  Synthetic
aaagugugugccaccacgcc

SEQ ID NO: 6218 - RNA, 20 nt, Artificial Sequence
  Synthetic
guggcacacacuuuuaaucc

SEQ ID NO: 6219 - RNA, 20 nt, Artificial Sequence
  Synthetic
acacuuuuaaucccggcacu

SEQ ID NO: 6220 - RNA, 20 nt, Artificial Sequence
  Synthetic
cacuuuuaaucccggcacuu

SEQ ID NO: 6221 - RNA, 20 nt, Artificial Sequence
  Synthetic
uuuuaaucccggcacuuggg

SEQ ID NO: 6222 - RNA, 20 nt, Artificial Sequence
  Synthetic
ucccggcacuugggaggcag

SEQ ID NO: 6223 - RNA, 20 nt, Artificial Sequence
  Synthetic
gccucugccucccaagugcc

SEQ ID NO: 6224 - RNA, 20 nt, Artificial Sequence
  Synthetic
ugccucugccucccaagugc

SEQ ID NO: 6225 - RNA, 20 nt, Artificial Sequence
  Synthetic
acuugggaggcagaggcaag

SEQ ID NO: 6226 - RNA, 20 nt, Artificial Sequence
  Synthetic
caagcggauuucugaguucg

SEQ ID NO: 6227 - RNA, 20 nt, Artificial Sequence
  Synthetic
uucugaguucgaggccagcu

SEQ ID NO: 6228 - RNA, 20 nt, Artificial Sequence
  Synthetic
acucacuuuguagaccaagc

SEQ ID NO: 6229 - RNA, 20 nt, Artificial Sequence
  Synthetic
uggucuacaaagugaguucc

SEQ ID NO: 6230 - RNA, 20 nt, Artificial Sequence
  Synthetic
aagugaguuccaggacagcc

SEQ ID NO: 6231 - RNA, 20 nt, Artificial Sequence
  Synthetic
agugaguuccaggacagcca

SEQ ID NO: 6232 - RNA, 20 nt, Artificial Sequence
  Synthetic
cuguguagcccuggcugucc

SEQ ID NO: 6233 - RNA, 20 nt, Artificial Sequence
  Synthetic
aggguuucucuguguagccc

SEQ ID NO: 6234 - RNA, 20 nt, Artificial Sequence
  Synthetic
ucuuuugguuuuucaagaca

SEQ ID NO: 6235 - RNA, 20 nt, Artificial Sequence
  Synthetic
uucuuuugguuuuucaagac

SEQ ID NO: 6236 - RNA, 20 nt, Artificial Sequence
  Synthetic
acagcuuucuuuuuuucuuu

SEQ ID NO: 6237 - RNA, 20 nt, Artificial Sequence
  Synthetic
uauauuaauauagcaaagca

SEQ ID NO: 6238 - RNA, 20 nt, Artificial Sequence
  Synthetic
auauauuaauauagcaaagc

SEQ ID NO: 6239 - RNA, 20 nt, Artificial Sequence
  Synthetic
uguuuuuucuuauagaauua

SEQ ID NO: 6240 - RNA, 20 nt, Artificial Sequence
  Synthetic
uucuggagggaggaaaagga

SEQ ID NO: 6241 - RNA, 20 nt, Artificial Sequence
  Synthetic
cucauucuggagggaggaaa

SEQ ID NO: 6242 - protein, 1379 aa, Artificial Sequence
  Synthetic
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSPKKKRKV

SEQ ID NO: 6243 - RNA, 4514 nt, Artificial Sequence
  Synthetic
gggucccgcagucggcguccagcggcucugcuuguucgugugugugucguugcaggccuuauucggauccauggauaagaaguacucaaucgggcuggauaucggaacuaauuccguggguugggcagugaucacggaugaauacaaagugccguccaagaaguucaagguccuggggaacaccgauagacacagcaucaagaaaaaucucaucggagcccugcuguuugacuccggcgaaaccgcagaagcgacccggcucaaacguaccgcgaggcgacgcuacacccggcggaagaaucgcaucugcuaucugcaagagaucuuuucgaacgaaauggcaaaggucgacgacagcuucuuccaccgccuggaagaaucuuuccugguggaggaggacaagaagcaugaacggcauccuaucuuuggaaacaucgucgacgaaguggcguaccacgaaaaguacccgaccaucuaccaucugcggaagaaguugguugacucaacugacaaggccgaccucagauugaucuacuuggcccucgcccauaugaucaaauuccgcggacacuuccugaucgaaggcgaucugaacccugauaacuccgacguggauaagcuuuucauucaacuggugcagaccuacaaccaacuguucgaagaaaacccaaucaaugcuagcggcgucgaugccaaggccauccuguccgcccggcugucgaagucgcggcgccucgaaaaccugaucgcacagcugccgggagagaaaaagaacggacuuuucggcaacuugaucgcucucucacugggacucacucccaauuucaaguccaauuuugaccuggccgaggacgcgaagcugcaacucucaaaggacaccuacgacgacgacuuggacaauuugcuggcacaaauuggcgaucaguacgcggaucuguuccuugccgcuaagaaccuuucggacgcaaucuugcuguccgauauccugcgcgugaacaccgaaauaaccaaagcgccgcuuagcgccucgaugauuaagcgguacgacgagcaucaccaggaucucacgcugcucaaagcgcucgugagacagcaacugccugaaaaguacaaggagaucuucuucgaccaguccaagaauggguacgcaggguacaucgauggaggcgcuagccaggaagaguucuauaaguucaucaagccaauccuggaaaagauggacggaaccgaagaacugcuggucaagcugaacagggaggaucugcuccggaaacagagaaccuuugacaacggauccauuccccaccagauccaucugggugagcugcacgccaucuugcggcgccaggaggacuuuuacccauuccucaaggacaaccgggaaaagaucgagaaaauucugacguuccgcaucccguauuacgugggcccacuggcgcgcggcaauucgcgcuucgcguggaugacuagaaaaucagaggaaaccaucacuccuuggaauuucgaggaaguuguggauaagggagcuucggcacaaagcuucaucgaacgaaugaccaacuucgacaagaaucucccaaacgagaaggugcuuccuaagcacagccuccuuuacgaauacuucacugucuacaacgaacugacuaaagugaaauacguuacugaaggaaugaggaagccggccuuucuguccggagaacagaagaaagcaauugucgaucugcuguucaagaccaaccgcaaggugaccgucaagcagcuuaaagaggacuacuucaagaagaucgaguguuucgacucaguggaaaucagcgggguggaggacagauucaacgcuucgcugggaaccuaucaugaucuccugaagaucaucaaggacaaggacuuccuugacaacgaggagaacgaggacauccuggaagauaucguccugaccuugacccuuuucgaggaucgcgagaugaucgaggagaggcuuaagaccuacgcucaucucuucgacgauaaggucaugaaacaacucaagcgccgccgguacacugguuggggccgccucucccgcaagcugaucaacgguauucgcgauaaacagagcgguaaaacuauccuggauuuccucaaaucggauggcuucgcuaaucguaacuucaugcaauugauccacgacgacagccugaccuuuaaggaggacauccaaaaagcacaaguguccggacagggagacucacuccaugaacacaucgcgaaucuggccgguucgccggcgauuaagaagggaauucugcaaacugugaagguggucgacgagcuggugaaggucaugggacggcacaaaccggagaauaucgugauugaaauggcccgagaaaaccagacuacccagaagggccagaaaaacucccgcgaaaggaugaagcggaucgaagaaggaaucaaggagcugggcagccagauccugaaagagcacccgguggaaaacacgcagcugcagaacgagaagcucuaccuguacuauuugcaaaauggacgggacauguacguggaccaagagcuggacaucaaucgguugucugauuacgacguggaccacaucguuccacaguccuuucugaaggaugacucgaucgauaacaagguguugacucgcagcgacaagaacagagggaagucagauaaugugccaucggaggaggucgugaagaagaugaagaauuacuggcggcagcuccugaaugcgaagcugauuacccagagaaaguuugacaaucucacuaaagccgagcgcggcggacucucagagcuggauaaggcuggauucaucaaacggcagcuggucgagacucggcagauuaccaagcacguggcgcagaucuuggacucccgcaugaacacuaaauacgacgagaacgauaagcucauccgggaagugaaggugauuacccugaaaagcaaacuugugucggacuuucggaaggacuuucaguuuuacaaagugagagaaaucaacaacuaccaucacgcgcaugacgcauaccucaacgcuguggucgguaccgcccugaucaaaaaguacccuaaacuugaaucggaguuuguguacggagacuacaaggucuacgacgugaggaagaugauagccaaguccgaacaggaaaucgggaaagcaacugcgaaauacuucuuuuacucaaacaucaugaacuuuuucaagacugaaauuacgcuggccaauggagaaaucaggaagaggccacugaucgaaacuaacggagaaacgggcgaaaucgugugggacaagggcagggacuucgcaacuguucgcaaagugcucucuaugccgcaagucaauauugugaagaaaaccgaagugcaaaccggcggauuuucaaaggaaucgauccucccaaagagaaauagcgacaagcucauugcacgcaagaaagacugggacccgaagaaguacggaggauucgauucgccgacugucgcauacuccguccucgugguggccaagguggagaagggaaagagcaaaaagcucaaauccgucaaagagcugcuggggauuaccaucauggaacgauccucguucgagaagaacccgauugauuuccucgaggcgaaggguuacaaggaggugaagaaggaucugaucaucaaacuccccaaguacucacuguucgaacuggaaaauggucggaagcgcaugcuggcuucggccggagaacuccaaaaaggaaaugagcuggccuugccuagcaaguacgucaacuuccucuaucuugcuucgcacuacgaaaaacucaaagggucaccggaagauaacgaacagaagcagcuuuucguggagcagcacaagcauuaucuggaugaaaucaucgaacaaaucuccgaguuuucaaagcgcgugauccucgccgacgccaaccucgacaaaguccugucggccuacaauaagcauagagauaagccgaucagagaacaggccgagaacauuauccacuuguucacccugacuaaccugggagccccagccgccuucaaguacuucgauacuacuaucgaucgcaaaagauacacguccaccaaggaaguucuggacgcgacccugauccaccaaagcaucacuggacucuacgaaacuaggaucgaucugucgcagcuggguggcgauggcgguggaucuccgaaaaagaagagaaagguguaaugagcuagccaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccucgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 6244 - DNA, 4245 bp, Artificial Sequence
  Synthetic
atggcccccaagaagaagcggaaggtgggcatccacggcgtgcccgccgccgacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacagcggcggcaagcggcccgccgccaccaagaaggccggccaggccaagaagaagaagggcagctacccctacgacgtgcccgactacgcctga

SEQ ID NO: 6245 - RNA, 4245 nt, Artificial Sequence
  Synthetic
auggcccccaagaagaagcggaaggugggcauccacggcgugcccgccgccgacaagaaguacagcaucggccuggacaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagaccgccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccggaagagcgaggagaccaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccugaagagcgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacccggcagaucaccaagcacguggcccagauccuggacagccggaugaacaccaaguacgacgagaacgacaagcugauccgggaggugaaggugaucacccugaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagaccaacggcgagaccggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcugaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacccggaucgaccugagccagcugggcggcgacagcggcggcaagcggcccgccgccaccaagaaggccggccaggccaagaagaagaagggcagcuaccccuacgacgugcccgacuacgccuga

SEQ ID NO: 6246 - protein, 1414 aa, Artificial Sequence
  Synthetic
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGKRPAATKKAGQAKKKKGSYPYDVPDYA

SEQ ID NO: 6247 - DNA, 4925 bp, Artificial Sequence
  Synthetic
ctagaactactgcacgatccaggatatcaatagttaagaaactaagacattggttcacttgctcaacttaaccaaaacaccacagacgggcttgcatatgacaacagttctagaggatcaaatgtccctgatcaaatgccctagcaggttctgtgtctgatgagggctgctggttcatgggtggtgctttttctcagtgtccttacaggtggaaggtatccagctttcttggaccttatattaaagcacgcattccattgatgtgagtagatagcttagtcagagccccaaagtgatttaagcacctccaaaaccctccgtctccggatgctcccccattggtgaacagatttcaacatagcaattgagcaggaggaaaggaagccaaattatttgatcacagccagtactttggtgaacacccaaacccagcatggagctgaatatctgtaatctcagtatccagcaggtggatattggggaattaagacttcaaggccagacttggctacatagtaagtttgatgccatcctgggctatatgagatcctgtttccaaaacccccaaatagaaacaataaaaaaatggcagtccttcatgttcactgctaccctagaaggtcagttttgcttgtaacagatgactaacagaggaacaaggtcccggaagagctaccagtatgctggctgccaatgaagctgctgaagtcttagtagatttaggagctatggtcctgacttccatcacagccccagcaccaccatgggcactgcccagcagtctatcttcttttaggtcttcaggtgtccctgggtagagaacaaggcttctgcttgcatagggctgatgccccagtacagtgacagtctcacaatgagtgcagcaatgtggccacagaacggggaaatgtgtgttctttaactagtagcttttataatcatgataaaaagataagtgtctactctcaagctgaaagcttttcacaggcatctgattctcttgctaaatgacaaagtggttagaggagggacctacagctttcattgtctacactcaggtttcttttgagaattttacagtaggtatgtattgttttctagtcaacacagaaataaaaggatttgttttgttgaaaagaagtgggggttttggtactgatgaggggaaattgatttatgttacttattcattctcaggttcatggctgagactccttatgacaaatgatagattaataaaagcatgcaaatgctggagctctgctggcggagtacctgatatgcaaggatgaagatctctgttcaatccccagaaatcaaataaaaaagctgggcatagtgaggaagaggagatgggaggattcctgtggctggctggacagctaacctagcctattcatctatttccaggccactaagggatggtaccttaaaaaataacaataataataaaaaataacaataataataaataaaaaaggtagctggttcctgaggagcatctaaggatatcctttaactccacgtgcacatacactgtatacacaggaacacatacaagcatgcagatttacctatcaagttttaccaaaaaaaaaaaaaaaaaaaaaaaagaacactttattcactgttggtgggtatgtaaactggcatatgtagccactatgaaaatcagcacagaggttcccttcccactccaacaaaacaaaacaaaacaaaacaaaacaaaacaaaacaaaacaaaacaaaaccctctagaactagaactagaactactgcacgactataatgatgatcttgttctttctgtttaattttactgtccctagcttcttagcatctgcggatgtttttcctggcagatatttactcaccatgacttcttccagaaggggtgttggtagctttcatgtgactatttctatttcacttttccatgtaacgagtgatgctgttggatttctctttcattaattagattttttctgtctcatccttttgctttagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgctagaactactgcacgatccagggttttagagctagaaatagcaagttaaaataaggctagtccgttatcaacttgaaaaagtggcaccgagtcggtgctttttttttccaggtttaccactcctaggtatttactcaaaggactctatacgtcaacctgtgacagaggcatcatatacaagcagggagtggtggcacctgcctttaatcccacccctcaggaggcagagtcaggtagatctctgtgagttcgaggccagtttggtctacatagtgagttctagtacagccataagaccatatagccatatggaggggggattgtgagcatagagtatgaatgttcttgagagaattattaaatgaattggaattattatacactgtcttctttcataggaaaaatgaacagaaagggagagatctttgggtggggctaacagcatacatgacatgaaagcagaaggggattagttattggaaggcagggagggacccaggaggatgaagggaagagaatgcaagggaaaggagtaaaggaggaggaggtagaggtacacactattaattccagcacttgtgaggaggggacagagctctgtgagttcaaggtcagccccctctgcatagtcagttccaggatagccaatggctacataatgagaccctgtgtcagagaaggtggccggcgagggatattgatgcttacagtttactttagccaccacacagctgaatgagttaaacctgttcctgctacttttgcactttcaatgctcccagattacttacatggaatttatattttattgtggtttaatagctcctgtacatcatagacaaacctcaagaaaaattttcaaccaatagtccaggcaaaaataacctctttttctttctttctttctttctttttttttttttttttttggttttttgaaacagggtttctctgtatagccctggctgtcctggaactcactttgtacaccaggctggcctcgaactcagaaatccacctgcctctgcctcccgagtgctcggattaaaggcgtgcaccaccaccgtcccgcaaaaaataacctgtttttgttgttttaattatttttaagattttatgtgtatgggtgtctgtctgtatgtatgtctgtgtaccacttgtatgcttggtgcccaagaaggacagaacagatcatagggtttcctgggataagagttataggagttatagatgactgtaagccaccaagtggacgctgggaattgaaccttggttagctggaagagtgtccagtatttttaattccagtccccgttgtttgtctatgaagattttgcttggtagtccagtctggctttaagaaacagggtctcatgcatccctggcttgctcagacttccatgcagctgaggatggctttagagtaacaaccctcctgccttttcctcgtagagtgctgagattacagtcctgtgccaccagcagacttctcctaacaagaatgtggcacagggaggcaactgggaatcaaacaggaaggaggagtaaaaggaaggggaggaaggagaggagaagtggcaggaggagaagaaaaaggaggcggagaaaaggtggtagtggtggaggaagaggaggaggaggaggaggaggaggagggggacttaatcagtaaaggaaaaaggctgagctcagtccttggaacctacatggtaggagagaatgagacttctgcaaagtttcctctgatccccacactggagcaatggtgccatcacatcactctcccacttcacccaactcctggatcgtgcagtagttctag

SEQ ID NO: 6248 - DNA, 5034 bp, Artificial Sequence
  Synthetic
ctagaactactgcacgatccaggaggcatctgattctcttgctaaatgacaaagtggttagaggagggacctacagctttcattgtctacactcaggtttcttttgagaattttacagtaggtatgtattgttttctagtcaacacagaaataaaaggatttgttttgttgaaaagaagtgggggttttggtactgatgaggggaaattgatttatgttacttattcattctcaggttcatggctgagactccttatgacaaatgatagattaataaaagcatgcaaatgctggagctctgctggcggagtacctgatatgcaaggatgaagatctctgttcaatccccagaaatcaaataaaaaagctgggcatagtgaggaagaggagatgggaggattcctgtggctggctggacagctaacctagcctattcatctatttccaggccactaagggatggtaccttaaaaaataacaataataataaaaaataacaataataataaataaaaaaggtagctggttcctgaggagcatctaaggatatcctttaactccacgtgcacatacactgtatacacaggaacacatacaagcatgcagatttacctatcaagttttaccaaaaaaaaaaaaaaaaaaaaaaaagaacactttattcactgttggtgggtatgtaaactggcatatgtagccactatgaaaatcagcacagaggttcccttcccactccaacaaaacaaaacaaaacaaaacaaaacaaaacaaaacaaaacaaaacaaaaccctctagaactagaactagaactactgcacgactataatgatgatcttgttctttctgtttaattttactgtccctagcttcttagcatctgcggatgtttttcctggcagatatttactcaccatgacttcttccagaaggggtgttggtagctttcatgtgactatttctatttcacttttccatgtaacgagtgatgctgttggatttctctttcattaattagattttttctgtctcatccttttgctttagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagacagaaacatacagtttcctaaagcctggctttgaatgcagaagggagcagctcctcctagttaagtttccactaaatcatcgccaaagaggacttcagagccctggggaggcagctgagggtctcaagggtgactgggtggcagggatgagtgcggtgggtgagaatcccggtgccctgagaggctatacgtgacaaatgaccaaaagcccaaggtaggggagtttcctctgctcacagttcttaccttcaaggcggatctgggcttccaccctcatgaacacagggattggggagggaccagagcgcccaatacacacagctccattatgcaatccattccagcaaattccccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgccttagattgggaggcctcattggccacttagagcgcagcctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaacccagcatctttctagtccctatgctgtatgcttgaacttcggaaaatgcttttccccgcccaatcttctctcaaatataaacacatcacacagggtgttgggggtggggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtatacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagtatgtggtagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgctagaactactgcacgatccagggttttagagctagaaatagcaagttaaaataaggctagtccgttatcaacttgaaaaagtggcaccgagtcggtgctttttttttccaggtttaccactcctaggtatttactcaaaggactctatacgtcaacctgtgacagaggcatcatatacaagcagggagtggtggcacctgcctttaatcccacccctcaggaggcagagtcaggtagatctctgtgagttcgaggccagtttggtctacatagtgagttctagtacagccataagaccatatagccatatggaggggggattgtgagcatagagtatgaatgttcttgagagaattattaaatgaattggaattattatacactgtcttctttcataggaaaaatgaacagaaagggagagatctttgggtggggctaacagcatacatgacatgaaagcagaaggggattagttattggaaggcagggagggacccaggaggatgaagggaagagaatgcaagggaaaggagtaaaggaggaggaggtagaggtacacactattaattccagcacttgtgaggaggggacagagctctgtgagttcaaggtcagccccctctgcatagtcagttccaggatagccaatggctacataatgagaccctgtgtcagagaaggtggccggcgagggatattgatgcttacagtttactttagccaccacacagctgaatgagttaaacctgttcctgctacttttgcactttcaatgctcccagattacttacatggaatttatattttattgtggtttaatagctcctgtacatcatagacaaacctcaagaaaaattttcaaccaatagtccaggcaaaaataacctctttttctttctttctttctttctttttttttttttttttttggttttttgaaacagggtttctctgtatagccctggctgtcctggaactcactttgtacaccaggctggcctggatcgtgcagtagttctag

SEQ ID NO: 6249 - DNA, 4296 bp, Artificial Sequence
  Synthetic
ctagaactactgcacgatccaggaagaggagatgggaggattcctgtggctggctggacagctaacctagcctattcatctatttccaggccactaagggatggtaccttaaaaaataacaataataataaaaaataacaataataataaataaaaaaggtagctggttcctgaggagcatctaaggatatcctttaactccacgtgcacatacactgtatacacaggaacacatacaagcatgcagatttacctatcaagttttaccaaaaaaaaaaaaaaaaaaaaaaaagaacactttattcactgttggtgggtatgtaaactggcatatgtagccactatgaaaatcagcacagaggttcccttcccactccaacaaaacaaaacaaaacaaaacaaaacaaaacaaaacaaaacaaaacaaaaccctctagaactagaactagaactactgcacgactataatgatgatcttgttctttctgtttaattttactgtccctagcttcttagcatctgcggatgtttttcctggcagatatttactcaccatgacttcttccagaaggggtgttggtagctttcatgtgactatttctatttcacttttccatgtaacgagtgatgctgttggatttctctttcattaattagattttttctgtctcatccttttgctttagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagacagaaacatacagtttcctaaagcctggctttgaatgcagaagggagcagctcctcctagttaagtttccactaaatcatcgccaaagaggacttcagagccctggggaggcagctgagggtctcaagggtgactgggtggcagggatgagtgcggtgggtgagaatcccggtgccctgagaggctatacgtgacaaatgaccaaaagcccaaggtaggggagtttcctctgctcacagttcttaccttcaaggcggatctgggcttccaccctcatgaacacagggattggggagggaccagagcgcccaatacacacagctccattatgcaatccattccagcaaattccccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgccttagattgggaggcctcattggccacttagagcgcagcctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaacccagcatctttctagtccctatgctgtatgcttgaacttcggaaaatgcttttccccgcccaatcttctctcaaatataaacacatcacacagggtgttgggggtggggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtatacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagtatgtggtagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgctagaactactgcacgatccagggttttagagctagaaatagcaagttaaaataaggctagtccgttatcaacttgaaaaagtggcaccgagtcggtgcttttttttttccaggtttaccactcctaggtatttactcaaaggactctatacgtcaacctgtgacagaggcatcatatacaagcagggagtggtggcacctgcctttaatcccacccctcaggaggcagagtcaggtagatctctgtgagttcgaggccagtttggtctacatagtgagttctagtacagccataagaccatatagccatatggaggggggattgtgagcatagagtatgaatgttcttgagagaattattaaatgaattggaattattatacactgtcttctttcataggaaaaatgaacagaaagggagagatctttgggtggggctaacagcatacatgacatgaaagcagaaggggattagttattggaaggcagggagggacccaggaggatgaagggaagagaatgcaagggaaaggagtaaaggaggaggaggtagaggtacacactattaattccagcacttgtgaggaggggacagagctctgtgagttcaaggtcagccccctggatcgtgcagtagttctag

We claim:

1. A method of expressing retinoschisin or integrating a coding sequence for a retinoschisin protein or functional fragment thereof into a target genomic locus in a retinal cell, comprising administering to the retinal cell a composition or combination comprising:
   (a) a nucleic acid construct comprising the coding sequence for the retinoschisin protein or functional fragment thereof for integration into the target genomic locus, wherein the coding sequence comprises exons 2-6 of human RS1 or encodes the same protein encoded by exons 2-6 of human RS1,
   wherein the nucleic acid construct does not comprise a promoter that drives expression of the retinoschisin protein or functional fragment thereof, and wherein:
      (I) the nucleic acid construct comprises a polyadenylation signal sequence located 3' of the coding sequence, and
      (II) the nucleic acid construct comprises a splice acceptor site located 5' of the coding sequence; and
   (b) a nuclease agent comprising a Cas protein or a nucleic acid encoding the Cas protein and a guide RNA or a DNA encoding the guide RNA, wherein the nuclease agent targets a nuclease target sequence in the target genomic locus,
   wherein the target genomic locus is in an endogenous RS1 locus comprising an endogenous RS1 gene,
   wherein integration of the nucleic acid construct into the endogenous RS1 locus prevents transcription of the endogenous RS1 gene downstream of the integration site,
   wherein the integration of the nucleic acid construct into the endogenous RS1 locus in the retinal cell reduces or eliminates expression of endogenous retinoschisin protein and replaces it with expression of the retinoschisin protein or functional fragment thereof encoded by the nucleic acid construct, and
   wherein (a) and (b) are administered simultaneously or sequentially, in any order.

2. The method of claim 1, wherein the splice acceptor site is from intron 1 of human RS1.

3. The method of claim 1, wherein the nucleic acid construct is for homology-independent targeted integration into the target genomic locus, wherein the nucleic acid construct comprises the coding sequence for the retinoschisin protein or functional fragment thereof flanked on each side by a nuclease target sequence for a nuclease agent.

4. The method of claim 3, wherein:
   (I) the nuclease target sequence in the target genomic locus is identical to the nuclease target sequence in the nucleic acid construct, and the nuclease target sequence in the target genomic locus is destroyed if the nucleic acid construct is inserted into the target genomic locus in the correct orientation but is reformed if the nucleic acid construct is inserted into the target genomic locus in the opposite orientation; or
   (II) the coding sequence for the retinoschisin protein or functional fragment thereof comprises complementary DNA (cDNA) comprising exons 2-6 of human RS1 or encoding the same protein encoded by exons 2-6 of human RS1,
      the nuclease target sequence in the target genomic locus is identical to the nuclease target sequence in the nucleic acid construct, and
      the nuclease target sequence in the target genomic locus is destroyed if the nucleic acid construct is inserted into the target genomic locus in the correct orientation but is reformed if the nucleic acid construct is inserted into the target genomic locus in the opposite orientation.

5. The method of claim 1, wherein the nucleic acid construct is for homologous recombination with the target genomic locus, wherein the nucleic acid construct comprises the coding sequence for the retinoschisin protein or functional fragment thereof flanked by homology arms on each side.

6. The method of claim 5, wherein the coding sequence and homology arms are further flanked on each side by a nuclease target sequence for a nuclease agent.

7. The method of claim 5, wherein each homology arm is between about 25 nucleotides and about 2.5 kb in length.

8. The method of claim 5, wherein the retinoschisin protein or functional fragment thereof is a human retinoschisin protein or functional fragment thereof, the coding sequence for the retinoschisin protein or functional fragment thereof comprises complementary DNA (cDNA) comprising exons 2-6 of human RS1 or encoding the same protein encoded by exons 2-6 of human RS1, and each homology arm is between about 25 nucleotides and about 2.5 kb in length.

9. The method of claim 1, wherein the nucleic acid construct is bidirectional and comprises:
   (a) a first segment comprising a first coding sequence for a first retinoschisin protein or functional fragment thereof, wherein the first coding sequence comprises exons 2-6 of human RS1 or encodes the same protein encoded by exons 2-6 of human RS1; and
   (b) a second segment comprising a reverse complement of a second coding sequence for a second retinoschisin protein or functional fragment thereof, wherein the second coding sequence comprises exons 2-6 of human RS1 or encodes the same protein encoded by exons 2-6 of human RS1.

10. The method of claim 9, wherein:
   (I) the nucleic acid construct does not comprise a homology arm; or
   (II) the first retinoschisin protein or functional fragment thereof is identical to the second retinoschisin protein or functional fragment thereof, and the second coding sequence adopts a different codon usage from the codon usage of the first coding sequence; or
   (III) the second segment is located 3' of the first segment, both the first retinoschisin protein or functional fragment thereof and the second retinoschisin protein or functional fragment thereof are a human retinoschisin protein or functional fragment thereof,
      the first retinoschisin protein or functional fragment thereof is identical to the second retinoschisin protein or functional fragment thereof,
      both the first coding sequence and the second coding sequence comprise complementary DNA (cDNA) comprising exons 2-6 of human RS1 or encoding the same protein encoded by exons 2-6 of human RS1,
      the second coding sequence adopts a different codon usage from the codon usage of the first coding sequence,
      the first segment comprises a first polyadenylation signal sequence located 3' of the first coding sequence, and the second segment comprises a reverse complement of a second polyadenylation signal sequence located 5' of the reverse complement of the second coding sequence,
      the first segment comprises a first splice acceptor site located 5' of the first coding sequence, and the second segment comprises a reverse complement of a second splice acceptor site located 3' of the reverse complement of the second coding sequence, the nucleic acid construct does not comprise a promoter that drives expression of the first retinoschisin protein or functional fragment thereof or the second retinoschisin protein or functional fragment thereof, and the nucleic acid construct does not comprise a homology arm.

11. The method of claim 1, wherein the nuclease target sequence in the target genomic locus is in the first intron in the endogenous RS1 gene at the endogenous RS1 locus.

12. The method of claim 1, wherein the nucleic acid construct is in an adeno-associated virus (AAV) viral vector.

13. The method of claim 12, wherein the AAV is selected from the group consisting of: AAV2; AAV5; AAV8; and AAV7m8.

14. The method of claim 1, wherein the Cas protein is a Cas9 protein.

15. The method of claim 14, wherein:
(I) the composition or combination comprises a DNA encoding the Cas9 protein, and wherein the composition or combination comprises the DNA encoding the guide RNA; or
(II) the composition or combination comprises a messenger RNA encoding the Cas9 protein, wherein the composition or combination comprises the guide RNA in the form of RNA.

16. The method of claim 15, wherein:
(I) the DNA encoding the Cas9 protein and the DNA encoding the guide RNA are in one or more viral vectors; or
(II) the guide RNA and the messenger RNA encoding the Cas9 protein are in a lipid nanoparticle.

17. The method of claim 1, wherein the endogenous RS1 locus comprises a mutated RS1 gene comprising a mutation that causes X-linked juvenile retinoschisis.

18. The method of claim 1, wherein the retinal cell is a human retinal cell.

19. The method of claim 1, wherein the retinal cell is in vivo in an animal.

* * * * *